United States Patent 9,719,131 (METHOD FOR DETERMINING THE DEGREE OF METHYLATION OF DEFINED CYTOSINES IN GENOMIC DNA IN THE SEQUENCE CONTEXT OF 5'-CPG-3') - sequence listing, part 13

SEQ ID NO: 39833 - DNA, 755 bp, Artificial Sequence
  chemically treated genomic DNA (Homo sapiens) CpG-island No: 39833
ggcgggcggtagcgtttgtggatagtatttgaggtcggggcggacgatgggtaggttttagtagtttcggcgttcgcgagataggtcgggacgggtaggagggaagttcggggaagggagcggcgcgtcgaggtttattaatttttatttttatttttttcggtattatagtgcggtagatgaagagcgtcgagggtttttttttttcgttcgtttggttgaggaagtgtaagatgaggttttcgttttggtcgtcgtcgcggttgagtaggttttcgaaaagttgggggtcggtgatgtcgaaagtcgtatatacgcggtcgcgtatttatagtattcgtaggtcgtttatggcgtcgcgtagtgtagagggagtcgggcgtagggcgggcgttcgtggtaacggcggttttagtaatgggcgtttcggaaacggtcgtagttcgtttcgtcgacggttcggcgtttgggggttgtaagttcggtagtgtttcgcgttcggtttttcgatttcgaattcgcgattcgtagtttacgttcggtttcgggatttcggaggcgcgtattaggttttcgggtcgtcgaggtaggttggttgttttttggtttcggtagcgcgtacgtttttggatgcggagcggattttcgtcgttaggagtcgtttcgggtcgttgtagtcgagggtgcgattttattttacgtcgatcggtttgtaagtagttcgtttattttgtagatgaagttggggttagaga

SEQ ID NO: 39834 - DNA, 755 bp, Artificial Sequence
  chemically treated genomic DNA (Homo sapiens) CpG-island No: 39834
tctctaaccccaacttcatctacaaaataaacgaactacttacaaaccgatcgacgtaaaataaaatcgcaccctcgactacaacgacccgaaacgactcctaacgacgaaaatccgctccgcatccaaaaacgtacgcgctaccgaaaccaaaaaacaaccaacctacctcgacgacccgaaaacctaatacgcgcctccgaaatcccgaaaccgaacgtaaactacgaatcgcgaattcgaaatcgaaaaaccgaacgcgaaacactaccgaacttacaacccccaaacgccgaaccgtcgacgaaacgaactacgaccgtttccgaaacgcccattactaaaaccgccgttaccacgaacgcccgccctacgcccgactccctctacactacgcgacgccataaacgacctacgaatactataaatacgcgaccgcgtatatacgactttcgacatcaccgacccccaacttttcgaaaacctactcaaccgcgacgacgaccaaaacgaaaacctcatcttacacttcctcaaccaaacgaacgaaaaaaaaaaaccctcgacgctcttcatctaccgcactataataccgaaaaaaataaaaataaaaattaataaacctcgacgcgccgctcccttccccgaacttccctcctacccgtcccgacctatctcgcgaacgccgaaactactaaaacctacccatcgtccgccccgacctcaaatactatccacaaacgctaccgcccgcc

SEQ ID NO: 39835 - DNA, 755 bp, Artificial Sequence
  chemically treated genomic DNA (Homo sapiens) CpG-island No: 39835
tttttagttttagttttatttgtaaggtgggcgggttgtttgtaaatcggtcggcgtggggtggggtcgtattttcggttgtagcggttcgaggcggtttttggcggcgagggttcgtttcgtatttaggggcgtgcgcgttgtcggggttagggagtaattagtttatttcggcggttcgggggtttggtgcgcgttttcgagatttcggggtcgggcgtgggttgcggatcgcgggttcgggatcgaggggtcgggcgcggggtattgtcgagtttgtagtttttagacgtcgggtcgtcggcggggcgagttgcggtcgttttcggggcgtttattgttagggtcgtcgttgttacggacgttcgttttgcgttcggttttttttgtattgcgcggcgttatggacgatttgcgggtgttgtggatgcgcgatcgcgtgtatgcggttttcggtattatcgatttttagtttttcgaggatttgtttaatcgcgacgacggttagggcgaggattttattttgtatttttttaattaggcgagcgaggaggaggggttttcggcgttttttatttatcgtattatggtgtcggaggaggtggaggtggagattggtgagtttcgacgcgtcgttttttttttcgggttttttttttgttcgtttcggtttatttcgcgggcgtcggggttgttagagtttgtttatcgttcgtttcggttttaggtgttgtttataaacgttgtcgttcgtt

SEQ ID NO: 39836 - DNA, 755 bp, Artificial Sequence
  chemically treated genomic DNA (Homo sapiens) CpG-island No: 39836
aacgaacgacaacgtttataaacaacacctaaaaccgaaacgaacgataaacaaactctaacaaccccgacgcccgcgaaataaaccgaaacgaacaaaaaaaaaacccgaaaaaaaaaacgacgcgtcgaaactcaccaatctccacctccacctcctccgacaccataatacgataaataaaaaacgccgaaaacccctcctcctcgctcgcctaattaaaaaaatacaaaataaaatcctcgccctaaccgtcgtcgcgattaaacaaatcctcgaaaaactaaaaatcgataataccgaaaaccgcatacacgcgatcgcgcatccacaacacccgcaaatcgtccataacgccgcgcaatacaaaaaaaaccgaacgcaaaacgaacgtccgtaacaacgacgaccctaacaataaacgccccgaaaacgaccgcaactcgccccgccgacgacccgacgtctaaaaactacaaactcgacaataccccgcgcccgacccctcgatcccgaacccgcgatccgcaacccacgcccgaccccgaaatctcgaaaacgcgcaccaaacccccgaaccgccgaaataaactaattactccctaaccccgacaacgcgcacgcccctaaatacgaaacgaaccctcgccgccaaaaaccgcctcgaaccgctacaaccgaaaatacgaccccaccccacgccgaccgatttacaaacaacccgcccaccttacaaataaaactaaaactaaaaa

SEQ ID NO: 39837 - DNA, 724 bp, Artificial Sequence
  chemically treated genomic DNA (Homo sapiens) CpG-island No: 39837
gattattcggcgtttttttaggtattgcgtcgtgattagacgagcggtgagcgatcgatatttttatgttagtttttggttttttaggggatatagtcgagtggtcggattaaacgtaacgagttttcgttagtttaaaggcgattcgatatcgttttagttgaagagaggttagtttgagtaattcgagagcggagttagttttagttttttagaagtggagaggtcgggtttagaggtatagatcgcgtaggcgttatgtgaagtagttaagttcggtttcgcgcgtgcgttttggaaaatttcgagggtggttcgagttgtttatgcgttttgagaatgtaatttagttcgtcgtcggtttgtttgcgggaggataaagggaaaggtttcgcgcgtgcgtatgttcgttttttggtagtggttttgcgtatgcgtgagggtaggtttttacggcgggttgttgtgcgttttagcggtttttggcgtcgcgttggtgtaggtttagtgcgtttgcgcgggttttatattttgttatatgtgtgttcgttgtttttaggtaattagtcgttgtttttgggtcgtaaggtaggttggaaacgatttcgtcgttaggttttaaatatgagtcgcgagaaatgtagtttcggggaaggcgttgaggagggaagggggtttgaggtttcggggtttaaggttagtgcggggtacgggggatttttgg

SEQ ID NO: 39838 - DNA, 724 bp, Artificial Sequence
  chemically treated genomic DNA (Homo sapiens) CpG-island No: 39838
ccaaaaatcccccgtaccccgcactaaccttaaaccccgaaacctcaaacccccttccctcctcaacgccttccccgaaactacatttctcgcgactcatatttaaaacctaacgacgaaatcgtttccaacctaccttacgacccaaaaacaacgactaattacctaaaaacaacgaacacacatataacaaaatataaaacccgcgcaaacgcactaaacctacaccaacgcgacgccaaaaaccgctaaaacgcacaacaacccgccgtaaaaacctaccctcacgcatacgcaaaaccactaccaaaaaacgaacatacgcacgcgcgaaacctttccctttatcctcccgcaaacaaaccgacgacgaactaaattacattctcaaaacgcataaacaactcgaaccaccctcgaaattttccaaaacgcacgcgcgaaaccgaacttaactacttcacataacgcctacgcgatctatacctctaaacccgacctctccacttctaaaaaactaaaactaactccgctctcgaattactcaaactaacctctcttcaactaaaacgatatcgaatcgcctttaaactaacgaaaactcgttacgtttaatccgaccactcgactatatcccctaaaaaaccaaaaactaacataaaaatatcgatcgctcaccgctcgtctaatcacgacgcaatacctaaaaaaacgccgaataatc

SEQ ID NO: 39839 - DNA, 724 bp, Artificial Sequence
  chemically treated genomic DNA (Homo sapiens) CpG-island No: 39839
ttagaggtttttcgtatttcgtattggttttgagtttcgaggttttagatttttttttttttttagcgtttttttcggggttgtatttttcgcggtttatatttgggatttgacggcggaatcgtttttagtttgttttgcggtttaggggtagcggttggttgtttaaaagtagcggatatatatatagtagagtataaaattcgcgtaggcgtattaggtttatattaacgcgacgttaagaatcgttaaagcgtatagtagttcgtcgtaagggtttgtttttacgtatgcgtaaaattattgttaagagacgagtatacgtacgcgcggaatttttttttttattttttcgtaggtaggtcggcgacgagttaaattgtatttttagagcgtatgggtaattcgagttattttcggggttttttaaggcgtacgcgcgaggtcgggtttggttgttttatatgacgtttgcgcggtttatgtttttgaattcggtttttttatttttgaggaattggagttgatttcgttttcgagttgtttagattaatttttttttagttgggacggtgtcgagtcgtttttgggttggcgaagattcgttgcgtttggttcgattattcggttgtgttttttgaggagttagaggttagtataggagtatcgatcgtttatcgttcgtttgattacgacgtagtgtttggaggagcgtcgagtgatt

SEQ ID NO: 39840 - DNA, 724 bp, Artificial Sequence
  chemically treated genomic DNA (Homo sapiens) CpG-island No: 39840
aatcactcgacgctcctccaaacactacgtcgtaatcaaacgaacgataaacgatcgatactcctatactaacctctaactcctcaaaaaacacaaccgaataatcgaaccaaacgcaacgaatcttcgccaacccaaaaacgactcgacaccgtcccaactaaaaaaaaattaatctaaacaactcgaaaacgaaatcaactccaattcctcaaaaataaaaaaaccgaattcaaaaacataaaccgcgcaaacgtcatataaaacaaccaaacccgacctcgcgcgtacgccttaaaaaaccccgaaaataactcgaattacccatacgctctaaaaatacaatttaactcgtcgccgacctacctacgaaaaaataaaaaaaaaaattccgcgcgtacgtatactcgtctcttaacaataattttacgcatacgtaaaaacaaacccttacgacgaactactatacgctttaacgattcttaacgtcgcgttaatataaacctaatacgcctacgcgaattttatactctactatatatatatccgctacttttaaacaaccaaccgctacccctaaaccgcaaaacaaactaaaaacgattccgccgtcaaatcccaaatataaaccgcgaaaaatacaaccccgaaaaaaacgctaaaaaaaaaaaaaaatctaaaacctcgaaactcaaaaccaatacgaaatacgaaaaacctctaa

SEQ ID NO: 39841 - DNA, 628 bp, Artificial Sequence
  chemically treated genomic DNA (Homo sapiens) CpG-island No: 39841
gcgggttagttttcggttttgttggtagttttcgggtttcgggtgggtttggtcggcgtagttttacgggtcgtattttttttcggcgagaggacgggaagcggggtcgggtagggagggcgttggtagggaaggaagtggtattagttgttcgtttacggttttgtcgtggaggggaagagcggttaagttcgcgttttttcggttcgcgttgggtagagggagtcgagcgcggagaggtggggtcgcgggaggggttggaggagtcgggtttcggttttttatttcgttcggagttcgcgggtcgttttttttgagtcgcggtttagggagcgagtgttttcggtcgttagaggcgcgggatggaagtttagggcggtttcgagtttggggacgacggggcggtcgttagttcgtaggcggtggtttatttttcgcgggaaagcgggcgtaagagcggaggcgcggggcgtacggaggtcggggagcgcgggtaggagttgggggcgtattacgtgattcgcgttcgcgcgtcgttgtaattttatatttagggttcgtttttcggggtggaagttgaggaatgttttttgtgtggataagttttttagaggagtcgtcgtttttt

SEQ ID NO: 39842 - DNA, 628 bp, Artificial Sequence
  chemically treated genomic DNA (Homo sapiens) CpG-island No: 39842
aaaaaacgacgactcctctaaaaaacttatccacacaaaaaacattcctcaacttccaccccgaaaaacgaaccctaaatataaaattacaacgacgcgcgaacgcgaatcacgtaatacgcccccaactcctacccgcgctccccgacctccgtacgccccgcgcctccgctcttacgcccgctttcccgcgaaaaataaaccaccgcctacgaactaacgaccgccccgtcgtccccaaactcgaaaccgccctaaacttccatcccgcgcctctaacgaccgaaaacactcgctccctaaaccgcgactcaaaaaaaacgacccgcgaactccgaacgaaataaaaaaccgaaacccgactcctccaacccctcccgcgaccccacctctccgcgctcgactccctctacccaacgcgaaccgaaaaaacgcgaacttaaccgctcttcccctccacgacaaaaccgtaaacgaacaactaataccacttccttccctaccaacgccctccctacccgaccccgcttcccgtcctctcgccgaaaaaaaatacgacccgtaaaactacgccgaccaaacccacccgaaacccgaaaactaccaacaaaaccgaaaactaacccgc

SEQ ID NO: 39843 - DNA, 628 bp, Artificial Sequence
  chemically treated genomic DNA (Homo sapiens) CpG-island No: 39843
gagaggcggcggtttttttggaaaatttgtttatataaaaggtattttttagtttttatttcgaaaggcgagttttgggtgtagggttatagcggcgcgcggacgcggattacgtggtgcgtttttagtttttgttcgcgtttttcggttttcgtgcgtttcgcgttttcgtttttgcgttcgttttttcgcgggaagtgggttatcgtttgcgagttggcggtcgtttcgtcgtttttaagttcggggtcgttttggatttttatttcgcgtttttgacggtcggggatattcgttttttgggtcgcggtttaggagaggcggttcgcgggtttcgggcggggtgggaggtcgaggttcggtttttttagtttttttcgcggttttattttttcgcgttcggttttttttgtttagcgcgggtcgggaaggcgcgggtttggtcgttttttttttttacggtaaagtcgtgaacggatagttgatgttatttttttttttgttagcgttttttttgttcgatttcgtttttcgttttttcgtcgggagggagtgcggttcgtggggttgcgtcggttagatttattcggggttcgggggttgttagtagagtcgggagttggttcgt

SEQ ID NO: 39844 - DNA, 628 bp, Artificial Sequence
  chemically treated genomic DNA (Homo sapiens) CpG-island No: 39844
acgaaccaactcccgactctactaacaacccccgaaccccgaataaatctaaccgacgcaaccccacgaaccgcactccctcccgacgaaaaaacgaaaaacgaaatcgaacaaaaaaaacgctaacaaaaaaaaaaataacatcaactatccgttcacgactttaccgtaaaaaaaaaaaacgaccaaacccgcgccttcccgacccgcgctaaacaaaaaaaaccgaacgcgaaaaaataaaaccgcgaaaaaaactaaaaaaaccgaacctcgacctcccaccccgcccgaaacccgcgaaccgcctctcctaaaccgcgacccaaaaaacgaatatccccgaccgtcaaaaacgcgaaataaaaatccaaaacgaccccgaacttaaaaacgacgaaacgaccgccaactcgcaaacgataacccacttcccgcgaaaaaacgaacgcaaaaacgaaaacgcgaaacgcacgaaaaccgaaaaacgcgaacaaaaactaaaaacgcaccacgtaatccgcgtccgcgcgccgctataaccctacacccaaaactcgcctttcgaaataaaaactaaaaaataccttttatataaacaaattttccaaaaaaaccgccgcctctc

SEQ ID NO: 39845 - DNA, 681 bp, Artificial Sequence
  chemically treated genomic DNA (Homo sapiens) CpG-island No: 39845
  misc_feature (438)..(438): n is either a, c, g or t
  misc_feature (551)..(551): n is either a, c, g or t
tgtattttattcgttttcgtttttattttcgttttagttcgtagcggttatagttcgggaggttttaagggaattttcgtacgtttgcgcgcgtaattacgggacggcgggtcggcgtggcgcgcgtaattgttttggaaattacggcgcgcgtacgcgtaaacgcgggtgatggggggaagaaagattgagttgagagttttgtcgcggggggagggttttatttcgttttttcgcggtgggcgcgcgcgttggttcgtttttttgttgtacgttttcggttcgcgcgtttttttcggtgttttttttcgttttataagtatttttgttttttcgtatttgtgcgtcggtgtagtaggtagtgggaatattcgggtattttcgtagttgagcggcgattcgggcggcggcggcggtcgaggagtttttatggtaggnacgaggcggagggaaggcgaaaggggggcgaggaagtaaattagagttttcgcgggggcggttttcgagggaggtatagagggaaacggtttttttaattcgaggagggttangcgcggagttttgtcgtattttttcgcgtatttttgtttagtttcgggtttcggagatgtatttgtattaggtttttatcggagttgttaattttggagataattgttatttcgtgggtagcgtcgggga

SEQ ID NO: 39846 - DNA, 681 bp, Artificial Sequence
  chemically treated genomic DNA (Homo sapiens) CpG-island No: 39846
  misc_feature (131)..(131): n is either a, c, g or t
  misc_feature (244)..(244): n is either a, c, g or t
tccccgacgctacccacgaaataacaattatctccaaaattaacaactccgataaaaacctaatacaaatacatctccgaaacccgaaactaaacaaaaatacgcgaaaaaatacgacaaaactccgcgcntaaccctcctcgaattaaaaaaaccgtttccctctatacctccctcgaaaaccgcccccgcgaaaactctaatttacttcctcgcccccctttcgccttccctccgcctcgtncctaccataaaaactcctcgaccgccgccgccgcccgaatcgccgctcaactacgaaaatacccgaatattcccactacctactacaccgacgcacaaatacgaaaaaacaaaaatacttataaaacgaaaaaaaacaccgaaaaaaacgcgcgaaccgaaaacgtacaacaaaaaaacgaaccaacgcgcgcgcccaccgcgaaaaaacgaaataaaaccctccccccgcgacaaaactctcaactcaatctttcttccccccatcacccgcgtttacgcgtacgcgcgccgtaatttccaaaacaattacgcgcgccacgccgacccgccgtcccgtaattacgcgcgcaaacgtacgaaaattcccttaaaacctcccgaactataaccgctacgaactaaaacgaaaataaaaacgaaaacgaataaaataca

SEQ ID NO: 39847 - DNA, 681 bp, Artificial Sequence
  chemically treated genomic DNA (Homo sapiens) CpG-island No: 39847
  misc_feature (131)..(131): n is either a, c, g or t
  misc_feature (244)..(244): n is either a, c, g or t
ttttcgacgttgtttacggagtagtagttgtttttagggttgatagtttcggtgaggatttgatgtagatgtattttcggagttcggggttgaatagaaatgcgcgggagggtgcgataaagtttcgcgtntgatttttttcgggttgagagagtcgtttttttttgtgtttttttcgaaaatcgttttcgcgaaggttttggtttattttttcgtttttttttcgtttttttttcgtttcgtntttgttatgggagtttttcgatcgtcgtcgtcgttcgggtcgtcgtttagttgcggaaatgttcggatgtttttattgtttgttgtatcggcgtataaatgcgggagggtaagggtgtttgtgaggcgggggagggtatcggggggaacgcgcgagtcgggagcgtgtagtaagggagcgggttagcgcgcgcgtttatcgcgggggagcgaggtagagtttttttttcgcggtaaagtttttagtttagttttttttttttttattattcgcgtttgcgcgtgcgcgcgtcgtggtttttagggtaattgcgcgcgttacgtcgattcgtcgtttcgtgattgcgcgcgtagacgtgcgggagtttttttggagtttttcgggttgtagtcgttgcggattggggcggaggtgggggcgggggcgagtggggtgta

SEQ ID NO: 39848 - DNA, 681 bp, Artificial Sequence
  chemically treated genomic DNA (Homo sapiens) CpG-island No: 39848
  misc_feature (438)..(438): n is either a, c, g or t
  misc_feature (551)..(551): n is either a, c, g or t
tacaccccactcgcccccgcccccacctccgccccaatccgcaacgactacaacccgaaaaactccaaaaaaactcccgcacgtctacgcgcgcaatcacgaaacgacgaatcgacgtaacgcgcgcaattaccctaaaaaccacgacgcgcgcacgcgcaaacgcgaataataaaaaaaaaaaaaactaaactaaaaactttaccgcgaaaaaaaaactctacctcgctcccccgcgataaacgcgcgcgctaacccgctcccttactacacgctcccgactcgcgcgttccccccgataccctcccccgcctcacaaacacccttaccctcccgcatttatacgccgatacaacaaacaataaaaacatccgaacatttccgcaactaaacgacgacccgaacgacgacgacgatcgaaaaactcccataacaaanacgaaacgaaaaaaaaacgaaaaaaaaacgaaaaaataaaccaaaaccttcgcgaaaacgattttcgaaaaaaacacaaaaaaaaacgactctctcaacccgaaaaaaatcanacgcgaaactttatcgcaccctcccgcgcatttctattcaaccccgaactccgaaaatacatctacatcaaatcctcaccgaaactatcaaccctaaaaacaactactactccgtaaacaacgtcgaaaa

SEQ ID NO: 39849 - DNA, 836 bp, Artificial Sequence
  chemically treated genomic DNA (Homo sapiens) CpG-island No: 39849
tcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacgggcgttgatgatttatttggacgagcgatttgatgttttttcgttggatgttgggtattcgttggcgttgatacggtcggcgttggatgagcgagcggtggtgttggggtcggatcgtgaaacgtttgtttgtcggggtgaaatcgttggtttgttcgttttgatggtttttgggattggcggttcgtttttttggggtgtggtggtcggcggcgttcgcgtgtcgtggcgcgcgcgtttgcgttttgcgcgggtgttttttgcgtcgtggggttgtttcgggtttgtgcgcgttgcgtcgcggttgttcgcgtcgcgcgtttttttgcgtttttcgcggtgggtggtcgcggtcgcgtcgcgtgggtgtttttgttcgcgtcgtcgtttgtgtttgttgtcgcgtcgtttttttttcgcgttttgtttttcgtttttttcgttttcggcggtttcggtgt

SEQ ID NO: 39850 - DNA, 836 bp, Artificial Sequence
  chemically treated genomic DNA (Homo sapiens) CpG-island No: 39850
acaccgaaaccgccgaaaacgaaaaaaacgaaaaacaaaacgcgaaaaaaaaacgacgcgacaacaaacacaaacgacgacgcgaacaaaaacacccacgcgacgcgaccgcgaccacccaccgcgaaaaacgcaaaaaaacgcgcgacgcgaacaaccgcgacgcaacgcgcacaaacccgaaacaaccccacgacgcaaaaaacacccgcgcaaaacgcaaacgcgcgcgccacgacacgcgaacgccgccgaccaccacaccccaaaaaaacgaaccgccaatcccaaaaaccatcaaaacgaacaaaccaacgatttcaccccgacaaacaaacgtttcacgatccgaccccaacaccaccgctcgctcatccaacgccgaccgtatcaacgccaacgaatacccaacatccaacgaaaaaacatcaaatcgctcgtccaaataaatcatcaacgcccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccga

SEQ ID NO: 39851 - DNA, 836 bp, Artificial Sequence
  chemically treated genomic DNA (Homo sapiens) CpG-island No: 39851
atatcggaatcgtcgggagcggggagggcgaaaaatagggcgcgagaaaggaacggcgcgataataaatataaacgacggcgcgagtaaaggtatttacgcggcgcgatcgcgattatttatcgcgaaaagcgtaagaaaacgcgcggcgcgaataatcgcggcgtaacgcgtataaattcgaggtagttttacggcgtaggagatattcgcgtaagacgtaaacgcgcgcgttacgatacgcgggcgtcgtcgattattatattttagaggagcgggtcgttaattttagaaattattagagcgggtaaattaacggttttatttcggtaaataaacgttttacggttcgattttagtattatcgttcgtttatttagcgtcgatcgtgttaacgttagcgagtatttaatatttagcgaggagatattaggtcgttcgtttagataggttattaacgttcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcga

SEQ ID NO: 39852 - DNA, 836 bp, Artificial Sequence
  chemically treated genomic DNA (Homo sapiens) CpG-island No: 39852
tcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgaacgttaataacctatctaaacgaacgacctaatatctcctcgctaaatattaaatactcgctaacgttaacacgatcgacgctaaataaacgaacgataatactaaaatcgaaccgtaaaacgtttatttaccgaaataaaaccgttaatttacccgctctaataatttctaaaattaacgacccgctcctctaaaatataataatcgacgacgcccgcgtatcgtaacgcgcgcgtttacgtcttacgcgaatatctcctacgccgtaaaactacctcgaatttatacgcgttacgccgcgattattcgcgccgcgcgttttcttacgcttttcgcgataaataatcgcgatcgcgccgcgtaaatacctttactcgcgccgtcgtttatatttattatcgcgccgttcctttctcgcgccctatttttcgccctccccgctcccgacgattccgatat

SEQ ID NO: 39853 - DNA, 615 bp, Artificial Sequence
  chemically treated genomic DNA (Homo sapiens) CpG-island No: 39853
ttcggtgcgtgttcgtttttttgttgaaacggattttagtggttttcgggtttttcgggcgtttttttttagtttcgttagtttgagggtcgcgtttagagagcggggagtttttttcggggcgtcgattaggttttcgcgtcgtagtcgtcgttttcggcgttttttaggttcggtttttgtcgagttcgttgcggtttacgtggtttggtagagttaaattcggtttgtaggaagttcggagttaagggaaagtcgagttaagttggggtgggcggggtcgaacggaggcgtagagtcgggaggggcgggtattgggcggaggaaggggagggtcgcgcgtaggggaggcggtggttgggttttggcgcgttttggtattcggtttcggtcggttagggaaggcggttttttttcggtcgtttcgttttttattttcgttatattcgggggaaggtgttttcgagtttttttttatttttatttcgttttttcgttttttcggttttagttttcgtcggcggagtttattatgttagatagtttcgatattttgtaaagataaagagttttagatcggagggaggaggaggaggaagaagagcggagagagaa

SEQ ID NO: 39854 - DNA, 615 bp, Artificial Sequence
  chemically treated genomic DNA (Homo sapiens) CpG-island No: 39854
ttctctctccgctcttcttcctcctcctcctccctccgatctaaaactctttatctttacaaaatatcgaaactatctaacataataaactccgccgacgaaaactaaaaccgaaaaaacgaaaaaacgaaataaaaataaaaaaaaactcgaaaacaccttcccccgaatataacgaaaataaaaaacgaaacgaccgaaaaaaaaccgccttccctaaccgaccgaaaccgaataccaaaacgcgccaaaacccaaccaccgcctcccctacgcgcgaccctccccttcctccgcccaatacccgcccctcccgactctacgcctccgttcgaccccgcccaccccaacttaactcgactttcccttaactccgaacttcctacaaaccgaatttaactctaccaaaccacgtaaaccgcaacgaactcgacaaaaaccgaacctaaaaaacgccgaaaacgacgactacgacgcgaaaacctaatcgacgccccgaaaaaaactccccgctctctaaacgcgaccctcaaactaacgaaactaaaaaaaaacgcccgaaaaacccgaaaaccactaaaatccgtttcaacaaaaaaacgaacacgcaccgaa

SEQ ID NO: 39855 - DNA, 615 bp, Artificial Sequence
  chemically treated genomic DNA (Homo sapiens) CpG-island No: 39855
tttttttttcgtttttttttttttttttttttttttcggtttagggttttttgtttttgtaaagtgtcgaaattgtttggtatagtgggtttcgtcggcggaggttggagtcgaggaagcgaggaggcgggatgagggtgggagagggttcgggaatattttttttcgggtgtaacgggagtgaaaggcggggcgatcgaggaggggtcgttttttttggtcggtcggggtcgggtgttagggcgcgttagagtttagttatcgttttttttgcgcgcggttttttttttttttcgtttagtgttcgtttttttcgattttgcgttttcgttcggtttcgtttattttaatttggttcggtttttttttggtttcgggttttttgtaagtcgaatttagttttgttaagttacgtggatcgtagcgggttcggtagaggtcgagtttgggagacgtcggaggcggcggttgcggcgcggggatttgatcggcgtttcgagaggagtttttcgttttttggacgcggtttttaagttggcggggttaaggaagagcgttcgggaggttcgggagttattggggttcgttttagtaggaagacgggtacgtatcgag

SEQ ID NO: 39856 - DNA, 615 bp, Artificial Sequence
  chemically treated genomic DNA (Homo sapiens) CpG-island No: 39856
ctcgatacgtacccgtcttcctactaaaacgaaccccaataactcccgaacctcccgaacgctcttccttaaccccgccaacttaaaaaccgcgtccaaaaaacgaaaaactcctctcgaaacgccgatcaaatccccgcgccgcaaccgccgcctccgacgtctcccaaactcgacctctaccgaacccgctacgatccacgtaacttaacaaaactaaattcgacttacaaaaaacccgaaaccaaaaaaaaaccgaaccaaattaaaataaacgaaaccgaacgaaaacgcaaaatcgaaaaaaacgaacactaaacgaaaaaaaaaaaaaaccgcgcgcaaaaaaaacgataactaaactctaacgcgccctaacacccgaccccgaccgaccaaaaaaaacgacccctcctcgatcgccccgcctttcactcccgttacacccgaaaaaaaatattcccgaaccctctcccaccctcatcccgcctcctcgcttcctcgactccaacctccgccgacgaaacccactataccaaacaatttcgacactttacaaaaacaaaaaaccctaaaccgaaaaaaaaaaaaaaaaaaaaaaaaacgaaaaaaaaa

SEQ ID NO: 39857 - DNA, 674 bp, Artificial Sequence
  chemically treated genomic DNA (Homo sapiens) CpG-island No: 39857
  misc_feature (305)..(305): n is either a, c, g or t
ttgtcgtatattttatttttttatatgtagtttacgggtgttacggatatatatttgcgttgcgtttaggttgcgcgttattcgttgtatgaagtggtttgcgtaggcgtaataatcggttttcgcgttcggcgggtgcgttttttcgcgcggttcgcgtcgcgcgcgtcgcgttgggcggcgcgtttcgcgcgtcggtcgtcgcgcgggtcgcggcgggacgcgcgcgcggtcgcggcgcgcgatcgttcgttgggtcgcgcgtcgtgcgcgcggtcgcggtcgtcgttcggcgtacgcgcggntcgcgttcggtcgcgcgcgggcggcgcggcgggcgaggtcgcgacgggtcgcgcgaggtcgagattcgcgcgcggcgcgtttcgttcgcggtcgcgcgttttgtcgcgttcggttttcgcgttcgcgttcgcgttcgcgtttcgcgtcggcgcgcgcgggtcgcgcgtcgcgtcgtcgcgagcggttttggttgtaggggcgatatttgttgggttttcggtgttgcgtggtcgtgttcgcgttattggcgcgtggttcgattttgcgcgttcgtcggcgcgttcgttgcgtattttaagcgttgtcgtatttttttcggttttttttgtcgtttttgtttattatttcggttagtgtttagatgttcg

SEQ ID NO: 39858 - DNA, 674 bp, Artificial Sequence
  chemically treated genomic DNA (Homo sapiens) CpG-island No: 39858
  misc_feature (370)..(370): n is either a, c, g or t
cgaacatctaaacactaaccgaaataataaacaaaaacgacaaaaaaaaccgaaaaaaatacgacaacgcttaaaatacgcaacgaacgcgccgacgaacgcgcaaaatcgaaccacgcgccaataacgcgaacacgaccacgcaacaccgaaaacccaacaaatatcgcccctacaaccaaaaccgctcgcgacgacgcgacgcgcgacccgcgcgcgccgacgcgaaacgcgaacgcgaacgcgaacgcgaaaaccgaacgcgacaaaacgcgcgaccgcgaacgaaacgcgccgcgcgcgaatctcgacctcgcgcgacccgtcgcgacctcgcccgccgcgccgcccgcgcgcgaccgaacgcganccgcgcgtacgccgaacgacgaccgcgaccgcgcgcacgacgcgcgacccaacgaacgatcgcgcgccgcgaccgcgcgcgcgtcccgccgcgacccgcgcgacgaccgacgcgcgaaacgcgccgcccaacgcgacgcgcgcgacgcgaaccgcgcgaaaaaacgcacccgccgaacgcgaaaaccgattattacgcctacgcaaaccacttcatacaacgaataacgcgcaacctaaacgcaacgcaaatatatatccgtaacacccgtaaactacatataaaaaaataaaatatacgacaa

SEQ ID NO: 39859 - DNA, 674 bp, Artificial Sequence
  chemically treated genomic DNA (Homo sapiens) CpG-island No: 39859
  misc_feature (370)..(370): n is either a, c, g or t
cgagtatttaagtattagtcgaagtaatggataagggcgataagagagatcggggagagtgcggtagcgtttaagatgcgtagcgggcgcgtcggcgagcgcgtagggtcgggttacgcgttagtaacgcgggtacggttacgtagtatcgggggtttagtagatgtcgtttttgtagttaaggtcgttcgcggcggcgcggcgcgcggttcgcgcgcgtcggcgcgaggcgcgggcgcgggcgcgggcgcgggggtcgggcgcggtagagcgcgcggtcgcgggcggggcgcgtcgcgcgcgggtttcggtttcgcgcggttcgtcgcggtttcgttcgtcgcgtcgttcgcgcgcggtcgggcgcggntcgcgcgtgcgtcgagcggcggtcgcggtcgcgcgtacggcgcgcggtttagcggacggtcgcgcgtcgcggtcgcgcgcgcgtttcgtcgcggttcgcgcggcgatcggcgcgcgaggcgcgtcgtttagcgcggcgcgcgcgacgcggatcgcgcggagaggcgtattcgtcgggcgcgagggtcggttgttgcgtttgcgtaggttattttatgtagcgagtggcgcgtagtttaaacgtaacgtaggtatgtgttcgtggtattcgtgggttgtatgtggaggggtggaatgtgcggtaa

SEQ ID NO: 39860 - DNA, 674 bp, Artificial Sequence
  chemically treated genomic DNA (Homo sapiens) CpG-island No: 39860
  misc_feature (305)..(305): n is either a, c, g or t
ttaccgcacattccacccctccacatacaacccacgaataccacgaacacatacctacgttacgtttaaactacgcgccactcgctacataaaataacctacgcaaacgcaacaaccgaccctcgcgcccgacgaatacgcctctccgcgcgatccgcgtcgcgcgcgccgcgctaaacgacgcgcctcgcgcgccgatcgccgcgcgaaccgcgacgaaacgcgcgcgcgaccgcgacgcgcgaccgtccgctaaaccgcgcgccgtacgcgcgaccgcgaccgccgctcgacgcacgcgcganccgcgcccgaccgcgcgcgaacgacgcgacgaacgaaaccgcgacgaaccgcgcgaaaccgaaacccgcgcgcgacgcgccccgcccgcgaccgcgcgctctaccgcgcccgacccccgcgcccgcgcccgcgcccgcgcctcgcgccgacgcgcgcgaaccgcgcgccgcgccgccgcgaacgaccttaactacaaaaacgacatctactaaacccccgatactacgtaaccgtacccgcgttactaacgcgtaacccgaccctacgcgctcgccgacgcgcccgctacgcatcttaaacgctaccgcactctccccgatctctcttatcgcccttatccattacttcgactaatacttaaatactcg

SEQ ID NO: 39861 - DNA, 666 bp, Artificial Sequence
  chemically treated genomic DNA (Homo sapiens) CpG-island No: 39861
tatttcgggttttgatttttcggggcgtcgacgcgaggggattcggttttcgtttttatttttatttttgtatgtgttagaaattttcgggcggattttcgcgtttgtcggttagtttttttgaattttttttcgcgggggttcgggagaaagagttgtttcgagtttttaaagtttttttgagtttttgcgttcgtcgggaggggtcgtttttcgggagtttttttttatatttcgaggtttttttattacgttttagttcgcgtttttttttggagcgtcggaagtttcgggtgttcgaggtcgttttttttaagaagttttttagattttttcgtttgcgttttagtgttagtttttttcgtcgtttttattcgatttcgagtttttgtttttttcgttttattgtttcggagtcgtaggtttaggtatatttttagtttcgggatttgtttagtcgggtcgcggcgttttcggattttcgttcgtttttggtttttatagcggggttttatcggtgcgtagagttaggagtagttatagagtttcgttcggatttcgtatggcgtcgtcggggttggttggggtcgggttggggttgggttcgggttcgaggaggttcgtagtagtcgggttttttttttgttttttttcgcgttggttcga

SEQ ID NO: 39862 - DNA, 666 bp, Artificial Sequence
  chemically treated genomic DNA (Homo sapiens) CpG-island No: 39862
tcgaaccaacgcgaaaaaaaacaaaaaaaaaacccgactactacgaacctcctcgaacccgaacccaaccccaacccgaccccaaccaaccccgacgacgccatacgaaatccgaacgaaactctataactactcctaactctacgcaccgataaaaccccgctataaaaaccaaaaacgaacgaaaatccgaaaacgccgcgacccgactaaacaaatcccgaaactaaaaatatacctaaacctacgactccgaaacaataaaacgaaaaaaacaaaaactcgaaatcgaataaaaacgacgaaaaaaactaacactaaaacgcaaacgaaaaaatctaaaaaacttcttaaaaaaaacgacctcgaacacccgaaacttccgacgctccaaaaaaaaacgcgaactaaaacgtaataaaaaaacctcgaaatataaaaaaaaactcccgaaaaacgacccctcccgacgaacgcaaaaactcaaaaaaactttaaaaactcgaaacaactctttctcccgaacccccgcgaaaaaaaattcaaaaaaactaaccgacaaacgcgaaaatccgcccgaaaatttctaacacatacaaaaataaaaataaaaacgaaaaccgaatcccctcgcgtcgacgccccgaaaaatcaaaacccgaaata

SEQ ID NO: 39863 - DNA, 666 bp, Artificial Sequence
  chemically treated genomic DNA (Homo sapiens) CpG-island No: 39863
tcgggttagcgcgagggggagtagggaggaagttcggttgttgcggattttttcggattcggatttagttttagttcggttttagttagtttcgacggcgttatgcggggttcgagcggggttttgtggttgtttttggttttgcgtatcggtgaggtttcgttgtgagagttaaaggcgggcgggggttcgggggcgtcgcggttcggttgagtaggtttcggggttggaaatgtgtttgagtttgcggtttcggggtagtgagacgggggaggtaggggttcggggtcgagtgaggacggcggagggaattagtattgaagcgtagacggggaagtttggaaggttttttggaggaggcggtttcgaatattcgaggttttcgacgttttaaggagaagcgcgggttgaggcgtggtggggaggtttcggggtgtggagaggagttttcggagggcggtttttttcgacgggcgtaggaatttaggaagattttgggggttcggagtagttttttttttcgagttttcgcgggagaagatttagagggattgatcggtaggcgcgggagttcgttcgggggtttttggtatatgtagggatggaggtggagacggaggtcgggttttttcgcgtcggcgtttcggggagttagggttcgggatg

SEQ ID NO: 39864 - DNA, 666 bp, Artificial Sequence
  chemically treated genomic DNA (Homo sapiens) CpG-island No: 39864
catcccgaaccctaactccccgaaacgccgacgcgaaaaaacccgacctccgtctccacctccatccctacatataccaaaaacccccgaacgaactcccgcgcctaccgatcaatccctctaaatcttctcccgcgaaaactcgaaaaaaaaaactactccgaacccccaaaatcttcctaaattcctacgcccgtcgaaaaaaaccgccctccgaaaactcctctccacaccccgaaacctccccaccacgcctcaacccgcgcttctccttaaaacgtcgaaaacctcgaatattcgaaaccgcctcctccaaaaaaccttccaaacttccccgtctacgcttcaatactaattccctccgccgtcctcactcgaccccgaacccctacctcccccgtctcactaccccgaaaccgcaaactcaaacacatttccaaccccgaaacctactcaaccgaaccgcgacgcccccgaacccccgcccgcctttaactctcacaacgaaacctcaccgatacgcaaaaccaaaaacaaccacaaaaccccgctcgaaccccgcataacgccgtcgaaactaactaaaaccgaactaaaactaaatccgaatccgaaaaaatccgcaacaaccgaacttcctccctactccccctcgcgctaacccga

SEQ ID NO: 39865 - DNA, 586 bp, Artificial Sequence
  chemically treated genomic DNA (Homo sapiens) CpG-island No: 39865
gataggcgcggcgacgaaaaaacggggtcgaggataacgggggagaaggcggaggggtaaaagatacggcggcgaggcgagggaaaaacggagcggcggggcggaggtaggaagatgcggagtcgaggggcgagggcgacggagacggggaaaaaggtgagagtggggggaagtagaaaggcgcgggacgcggcgcgcgcggggggaaatagagggaagagaggggcgggcggggcggacgaagagtgagggagggggcgcgggaggggaaacgtcgatagggggcgggaggaaggagtagtaatgacggaaagcggacgggaagggggaaaaagagagagaggggttggagcgggggggggagaaaaggggggggcggggcgagaggaaacggagggacggaagcggggggcgaagaggggggggggaaggggggggaaagggaaggggcggagagaggaaaggggaggggtaaaggaggaggaagggggggggggagaggcgggtaacgtaggaatggggtagtgttaaacggatgttatgtatagagcgggggtattatatttttgttatgttggagtagaga

SEQ ID NO: 39866 - DNA, 586 bp, Artificial Sequence
  chemically treated genomic DNA (Homo sapiens) CpG-island No: 39866
tctctactccaacataacaaaaatataatacccccgctctatacataacatccgtttaacactaccccattcctacgttacccgcctctcccccccccccttcctcctcctttacccctcccctttcctctctccgccccttccctttccccccccttcccccccccctcttcgccccccgcttccgtccctccgtttcctctcgccccgccccccccttttctcccccccccgctccaacccctctctctctttttcccccttcccgtccgctttccgtcattactactccttcctcccgccccctatcgacgtttcccctcccgcgccccctccctcactcttcgtccgccccgcccgcccctctcttccctctatttccccccgcgcgcgccgcgtcccgcgcctttctacttccccccactctcacctttttccccgtctccgtcgccctcgcccctcgactccgcatcttcctacctccgccccgccgctccgtttttccctcgcctcgccgccgtatcttttacccctccgccttctcccccgttatcctcgaccccgttttttcgtcgccgcgcctatc

SEQ ID NO: 39867 - DNA, 586 bp, Artificial Sequence
  chemically treated genomic DNA (Homo sapiens) CpG-island No: 39867
tttttattttaatataataaaagtataatgttttcgttttatgtatagtattcgtttaatattgttttatttttacgttattcgtttttttttttttttttttttttttttttgttttttttttttttttttttcgttttttttttttttttttttttttttttttttttttcgtttttcgttttcgttttttcgttttttttcgtttcgttttttttttttttttttttttcgttttagttttttttttttttttttttttttttcgttcgtttttcgttattgttgtttttttttttcgttttttgtcggcgttttttttttcgcgtttttttttttatttttcgttcgtttcgttcgttttttttttttttttgttttttttcgcgcgcgtcgcgtttcgcgtttttttgtttttttttatttttattttttttttcgttttcgtcgttttcgtttttcggtttcgtatttttttgttttcgtttcgtcgtttcgtttttttttcgtttcgtcgtcgtattttttgttttttcgttttttttttcgttgttttcgatttcgttttttcgtcgtcgcgtttgtt

SEQ ID NO: 39868 - DNA, 586 bp, Artificial Sequence
  chemically treated genomic DNA (Homo sapiens) CpG-island No: 39868
aacaaacgcgacgacgaaaaaacgaaatcgaaaacaacgaaaaaaaaaacgaaaaaacaaaaaatacgacgacgaaacgaaaaaaaaacgaaacgacgaaacgaaaacaaaaaaatacgaaaccgaaaaacgaaaacgacgaaaacgaaaaaaaaaataaaaataaaaaaaaacaaaaaaacgcgaaacgcgacgcgcgcgaaaaaaaacaaaaaaaaaaaaaaaacgaacgaaacgaacgaaaaataaaaaaaaaaacgcgaaaaaaaaaacgccgacaaaaaacgaaaaaaaaaaacaacaataacgaaaaacgaacgaaaaaaaaaaaaaaaaaaaaaaaaaactaaaacgaaaaaaaaaaaaaaaaaaaaaacgaaacgaaaaaaaacgaaaaaacgaaaacgaaaaacgaaaaaaaaaaaaaaaaaaaaaaaaaaaaaaaaaaaacgaaaaaaaaaaaaaaaaaaaacaaaaaaaaaaaaaaaaaaaaaaaaaaaaacgaataacgtaaaaataaaacaatattaaacgaatactatacataaaacgaaaacattatacttttattatattaaaataaaaa

SEQ ID NO: 39869 - DNA, 580 bp, Artificial Sequence
  chemically treated genomic DNA (Homo sapiens) CpG-island No: 39869
tttgtttttttttttcgttttttttttcgtttcgttcgttttttcgtttttttcggttgcgtttttttcgtgtttttttcgttttcggtttttcgtttttttcgttttcgtttcgcgtgtcgtttttgggcgcgtttttcgtttcgtttggtttttttcggattcggtcgttgtttttgtttttttcgcgtttcgttcgtaattttttcggagtcgtgcgtttaacgtttcggttcggttatttcgttttttttcgtttttcgtatttttgtttttttttttttcgtttttttcgaggtttttcgtcggagttttcgtcgtttgcgttttttttcgttttttttcgatttttttttcggtatttttttatttttttcgttcggttcgtttgtcgtcgcgtcgtcgtcgcgtttttgtttttttcgtcgtgcgttttgtttcgtcgcggtttcgttttgtgttttacgcgtatttgcgagttcggtcgtcgttcgttttcgtttttttcgtttttttcgttttcgttttcggtgatgatcgtttgcgttttttcgcgacgatcgagttttgcgaaggtgcg

SEQ ID NO: 39870 - DNA, 580 bp, Artificial Sequence
  chemically treated genomic DNA (Homo sapiens) CpG-island No: 39870
cgcaccttcgcaaaactcgatcgtcgcgaaaaaacgcaaacgatcatcaccgaaaacgaaaacgaaaaaaacgaaaaaaacgaaaacgaacgacgaccgaactcgcaaatacgcgtaaaacacaaaacgaaaccgcgacgaaacaaaacgcacgacgaaaaaaacaaaaacgcgacgacgacgcgacgacaaacgaaccgaacgaaaaaaataaaaaaataccgaaaaaaaaatcgaaaaaaaacgaaaaaaaacgcaaacgacgaaaactccgacgaaaaacctcgaaaaaaacgaaaaaaaaaaaaacaaaaatacgaaaaacgaaaaaaaacgaaataaccgaaccgaaacgttaaacgcacgactccgaaaaaattacgaacgaaacgcgaaaaaaacaaaaacaacgaccgaatccgaaaaaaaccaaacgaaacgaaaaacgcgcccaaaaacgacacgcgaaacgaaaacgaaaaaaacgaaaaaccgaaaacgaaaaaaacacgaaaaaaacgcaaccgaaaaaaacgaaaaaacgaacgaaacgaaaaaaaaaacgaaaaaaaaaaacaaa

SEQ ID NO: 39871 - DNA, 580 bp, Artificial Sequence
  chemically treated genomic DNA (Homo sapiens) CpG-island No: 39871
cgtattttcgtaaggttcgatcgtcgcgggaaggcgtagacggttattatcggaggcgggagcggggggggcggggagagcgaaagcgggcggcggtcgggttcgtaaatgcgcgtgaagtataagacggagtcgcggcgaggtagagcgtacggcggggggggtaaaaacgcggcggcggcgcggcggtagacgagtcggacggagggggtggggaagtatcgggggaaagatcgagagagggcggggggagacgtaggcgacggggatttcggcggggagtttcggggaaggcgggggggggggaggtaggaatgcggggagcggaggagagcggagtagtcgaatcggggcgttaaacgtacgatttcgggagaattgcggacgggacgcggggaaggtaaagatagcggtcgggttcggggggggttaaacggggcggggagcgcgtttaggaacggtacgcgggacgagggcggggggagcgggggatcgggaacggggggggtacgggaagggcgtagtcgggggaagcggaggggcgaacggggcgaaggggggggcggggaggggggataaa

SEQ ID NO: 39872 - DNA, 580 bp, Artificial Sequence
  chemically treated genomic DNA (Homo sapiens) CpG-island No: 39872
tttatcccccctccccgccccccccttcgccccgttcgcccctccgcttcccccgactacgcccttcccgtaccccccccgttcccgatcccccgctccccccgccctcgtcccgcgtaccgttcctaaacgcgctccccgccccgtttaaccccccccgaacccgaccgctatctttaccttccccgcgtcccgtccgcaattctcccgaaatcgtacgtttaacgccccgattcgactactccgctctcctccgctccccgcattcctacctcccccccccccgccttccccgaaactccccgccgaaatccccgtcgcctacgtctccccccgccctctctcgatctttcccccgatacttccccaccccctccgtccgactcgtctaccgccgcgccgccgccgcgtttttaccccccccgccgtacgctctacctcgccgcgactccgtcttatacttcacgcgcatttacgaacccgaccgccgcccgctttcgctctccccgccccccccgctcccgcctccgataataaccgtctacgccttcccgcgacgatcgaaccttacgaaaatacg

SEQ ID NO: 39873 - DNA, 691 bp, Artificial Sequence
  chemically treated genomic DNA (Homo sapiens) CpG-island No: 39873
  misc_feature (496)..(496): n is either a, c, g or t
  misc_feature (612)..(612): n is either a, c, g or t
  misc_feature (631)..(631): n is either a, c, g or t
gtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgcgtattcgttggcgttgatacggtcggcgttggatgagcgagcggtggtgtttgggtcggatcgtganacgttgttgtgcggtgtgaaagcgttgtttgtcggttatgaggttttttggttgttgatcggatttgtgggggttggggtcgtatcgggtttgggtttttcggttagggtggttantgggttgggaatgagtcgngggttttatcgggttttttcggtgtttttgttgtttttgataaatttgggtcgagttgga

SEQ ID NO: 39874 - DNA, 691 bp, Artificial Sequence
  chemically treated genomic DNA (Homo sapiens) CpG-island No: 39874
  misc_feature (61)..(61): n is either a, c, g or t
  misc_feature (80)..(80): n is either a, c, g or t
  misc_feature (196)..(196): n is either a, c, g or t
tccaactcgacccaaatttatcaaaaacaacaaaaacaccgaaaaaacccgataaaacccncgactcattcccaacccantaaccaccctaaccgaaaaacccaaacccgatacgaccccaacccccacaaatccgatcaacaaccaaaaaacctcataaccgacaaacaacgctttcacaccgcacaacaacgtntcacgatccgacccaaacaccaccgctcgctcatccaacgccgaccgtatcaacgccaacgaatacgcaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgac

SEQ ID NO: 39875 - DNA, 691 bp, Artificial Sequence
  chemically treated genomic DNA (Homo sapiens) CpG-island No: 39875
  misc_feature (61)..(61): n is either a, c, g or t
  misc_feature (80)..(80): n is either a, c, g or t
  misc_feature (196)..(196): n is either a, c, g or t
tttagttcggtttaggtttgttaaaggtaatagggatatcggaaaaattcggtaaagtttncggtttatttttaatttantgattattttgatcggaaaatttaaattcgatgcggttttagtttttatagattcggttaataattaagaagttttatgatcggtagatagcgtttttatatcgtataataacgtnttacggttcgatttaagtattatcgttcgtttatttagcgtcgatcgtgttaacgttagcgagtacgtaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgat

SEQ ID NO: 39876 - DNA, 691 bp, Artificial Sequence
  chemically treated genomic DNA (Homo sapiens) CpG-island No: 39876
  misc_feature (496)..(496): n is either a, c, g or t
  misc_feature (612)..(612): n is either a, c, g or t
  misc_feature (631)..(631): n is either a, c, g or t
atcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattacgtactcgctaacgttaacacgatcgacgctaaataaacgaacgataatacttaaatcgaaccgtaanacgttattatacgatataaaaacgctatctaccgatcataaaacttcttaattattaaccgaatctataaaaactaaaaccgcatcgaatttaaattttccgatcaaaataatcantaaattaaaaataaaccgnaaactttaccgaatttttccgatatccctattacctttaacaaacctaaaccgaactaaa

SEQ ID NO: 39877 - DNA, 608 bp, Artificial Sequence
  chemically treated genomic DNA (Homo sapiens) CpG-island No: 39877
ggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggggttgatgatttatttggacgagcgatttgatgttttttcgttggatgttgggtattcgttggcgttgatacggattgggttggatgagcgagcggtggtgttggggtcgatcgtgaacgttgttgtgcggtggaaagcgttgtttgtcgttatgaggtttttgggttgggatcggatttgtggggttggggttcgataggttttgtgttttcgttaggggttagtgt

SEQ ID NO: 39878 - DNA, 608 bp, Artificial Sequence
  chemically treated genomic DNA (Homo sapiens) CpG-island No: 39878
acactaacccctaacgaaaacacaaaacctatcgaaccccaaccccacaaatccgatcccaacccaaaaacctcataacgacaaacaacgctttccaccgcacaacaacgttcacgatcgaccccaacaccaccgctcgctcatccaacccaatccgtatcaacgccaacgaatacccaacatccaacgaaaaaacatcaaatcgctcgtccaaataaatcatcaaccccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgacccc

SEQ ID NO: 39879 - DNA, 608 bp, Artificial Sequence
  chemically treated genomic DNA (Homo sapiens) CpG-island No: 39879
gtattgatttttggcggaaatataaaatttatcgggttttagttttatagattcggttttaatttagaagttttatgacggtagatagcgttttttatcgtataataacgtttacggtcgattttagtattatcgttcgtttatttagtttagttcgtgttaacgttagcgagtatttaatatttagcgaggagatattaggtcgttcgtttagataggttattaatttcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgatttt

SEQ ID NO: 39880 - DNA, 608 bp, Artificial Sequence
  chemically treated genomic DNA (Homo sapiens) CpG-island No: 39880
aaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgaaattaataacctatctaaacgaacgacctaatatctcctcgctaaatattaaatactcgctaacgttaacacgaactaaactaaataaacgaacgataatactaaaatcgaccgtaaacgttattatacgataaaaaacgctatctaccgtcataaaacttctaaattaaaaccgaatctataaaactaaaacccgataaattttatatttccgccaaaaatcaatac

SEQ ID NO: 39881 - DNA, 873 bp, Artificial Sequence
  chemically treated genomic DNA (Homo sapiens) CpG-island No: 39881
cggtaaaagtcggtttttttcggtagggatcgttgtagtggtcgttggcggtcggcgcggcgatgtttcgttttcggcgcgagtttcggagttttcgggttggtaggtcgagtcggcggtttcgcgggggaggggcgggtcggggggcggtgcgaggtttagtcgggcgtttcgttggcgggtcgcgcgcgcgttcgcgtattttttttgttttcgaggcgcgtcgcgtttttttttttattcgttcgcgtaggttatcgttcgttgcgcgttttgtttcgcgtttcgtttcgttcgttttttgattggtcgtttttgttttttttttcgtttttttttttttttttttgcggtttgaagatgttttcggttattagttatagcgggagcggtagtaagtcgttcggatcgttatcgtcgtcgggttttttcgggagtgaggcggtcgcgggagtcggggtcgtcgcgtcggttttttagtatttcgtaatcggtatcggcgttgtttagatcgaggttatgaagtagattttcggggtgatcgataagaaatttcggaatttggagaagaaaaaggtgttaggagttggcggggaagggaggggtggttgcggtcgggttttgcggttttttcgattttggtcgttggagttttcgttttttttcgtttcgggagcgttattaggttttttttttttattttttggtttatacgtttcgtttttacgtttagcgggagtttcgtgtttagaaaacgggtttttggaagaggtatttgttatttgattcggacgcggtattgtattttaggtttttttattattttttcgttgtgggttcggttttttggtttttaggagtgggatatgtgag

SEQ ID NO: 39882 - DNA, 873 bp, Artificial Sequence
  chemically treated genomic DNA (Homo sapiens) CpG-island No: 39882
ctcacatatcccactcctaaaaaccaaaaaaccgaacccacaacgaaaaaataataaaaaaacctaaaatacaataccgcgtccgaatcaaataacaaatacctcttccaaaaacccgttttctaaacacgaaactcccgctaaacgtaaaaacgaaacgtataaaccaaaaaataaaaaaaaaaaacctaataacgctcccgaaacgaaaaaaaacgaaaactccaacgaccaaaatcgaaaaaaccgcaaaacccgaccgcaaccacccctcccttccccgccaactcctaacacctttttcttctccaaattccgaaatttcttatcgatcaccccgaaaatctacttcataacctcgatctaaacaacgccgataccgattacgaaatactaaaaaaccgacgcgacgaccccgactcccgcgaccgcctcactcccgaaaaaacccgacgacgataacgatccgaacgacttactaccgctcccgctataactaataaccgaaaacatcttcaaaccgcaaaaaaaaaaaaaaaaaaacgaaaaaaaaaacaaaaacgaccaatcaaaaaacgaacgaaacgaaacgcgaaacaaaacgcgcaacgaacgataacctacgcgaacgaataaaaaaaaaaacgcgacgcgcctcgaaaacaaaaaaaatacgcgaacgcgcgcgcgacccgccaacgaaacgcccgactaaacctcgcaccgccccccgacccgcccctcccccgcgaaaccgccgactcgacctaccaacccgaaaactccgaaactcgcgccgaaaacgaaacatcgccgcgccgaccgccaacgaccactacaacgatccctaccgaaaaaaaccgacttttaccg

SEQ ID NO: 39883 - DNA, 873 bp, Artificial Sequence
  chemically treated genomic DNA (Homo sapiens) CpG-island No: 39883
tttatatgttttatttttaaaggttaaaaagtcggatttatagcggaagagtaataaagaggtttggggtatagtgtcgcgttcgagttaggtgataagtgttttttttaagagttcgttttttgggtacgaagttttcgttgaacgtggagacggggcgtgtgggttagggggtgggaggaggggatttagtaacgttttcgagacgaaaagaagcgaaggttttagcgattagggtcggaggggtcgtagagttcggtcgtagttatttttttttttttcgttaatttttggtattttttttttttttaggtttcgaagttttttgtcgattatttcgagaatttgttttatggtttcggtttggatagcgtcggtgtcggttgcggggtgttgagaagtcggcgcggcggtttcggttttcgcggtcgttttattttcggaggaattcgacggcggtggcggttcggacgatttgttgtcgttttcgttgtggttggtggtcgagggtatttttagatcgtaaggagagagaagaaaaagcgggaggaaggataagagcggttagttaggagacggacggggcgagacgcgggataaaacgcgtagcgagcggtagtttacgcgagcgggtgggggagggggcgcggcgcgtttcgagggtaggaagagtgcgcgggcgcgcgcgcgattcgttagcggggcgttcggttgggtttcgtatcgtttttcgattcgtttttttttcgcggagtcgtcggttcggtttattagttcgggggtttcgaggttcgcgtcggaggcggggtatcgtcgcgtcggtcgttaacggttattgtaacggtttttatcggggagggtcggtttttgtcg

SEQ ID NO: 39884 - DNA, 873 bp, Artificial Sequence
  chemically treated genomic DNA (Homo sapiens) CpG-island No: 39884
cgacaaaaaccgaccctccccgataaaaaccgttacaataaccgttaacgaccgacgcgacgataccccgcctccgacgcgaacctcgaaacccccgaactaataaaccgaaccgacgactccgcgaaaaaaaaacgaatcgaaaaacgatacgaaacccaaccgaacgccccgctaacgaatcgcgcgcgcgcccgcgcactcttcctaccctcgaaacgcgccgcgccccctcccccacccgctcgcgtaaactaccgctcgctacgcgttttatcccgcgtctcgccccgtccgtctcctaactaaccgctcttatccttcctcccgctttttcttctctctccttacgatctaaaaataccctcgaccaccaaccacaacgaaaacgacaacaaatcgtccgaaccgccaccgccgtcgaattcctccgaaaataaaacgaccgcgaaaaccgaaaccgccgcgccgacttctcaacaccccgcaaccgacaccgacgctatccaaaccgaaaccataaaacaaattctcgaaataatcgacaaaaaacttcgaaacctaaaaaaaaaaaaaataccaaaaattaacgaaaaaaaaaaaaataactacgaccgaactctacgacccctccgaccctaatcgctaaaaccttcgcttcttttcgtctcgaaaacgttactaaatcccctcctcccaccccctaacccacacgccccgtctccacgttcaacgaaaacttcgtacccaaaaaacgaactcttaaaaaaaacacttatcacctaactcgaacgcgacactataccccaaacctctttattactcttccgctataaatccgactttttaacctttaaaaataaaacatataaa

SEQ ID NO: 39885 - DNA, 535 bp, Artificial Sequence
  chemically treated genomic DNA (Homo sapiens) CpG-island No: 39885
  misc_feature (451)..(451): n is either a, c, g or t
cgtcgttttttatttttttttcgttatttgtttaattttaattggaatcgtgagtagcgttttttttttcgttttagtggagtggacgatttttcgcggttttgttttttcgttcgtgtcgtcgcgtatttttgtttttacgtcgtcgtcgcgcgttttttcggttttagttcgtacgcgtttcgcgttcggtttcggttggtttttattcgttgtggttttttttttttttcgcgggcggtttttttttttttttttttttttttcgttttttcggtcgcggtacgtgggtcgtgttcggcggtttgtcgcgtggacgtggtcgtcgcgttttcgttcgcgttgttgcgttttcgtcggcgcgggtgtcgtcgcgtcgcgcgcgttttcgtcggcggtttcgcgtcgttttatttgcgggtcgggcgcgcgtcgcgatttttcggtgcgncgttttttcgcgggtgtcgcgtttgcgttttgttttcgcgtcgcgggttcgatacggtgattgcgtggatttttttttgtgttt

SEQ ID NO: 39886 - DNA, 535 bp, Artificial Sequence
  chemically treated genomic DNA (Homo sapiens) CpG-island No: 39886
  misc_feature (85)..(85): n is either a, c, g or t
aaacacaaaaaaaaatccacgcaatcaccgtatcgaacccgcgacgcgaaaacaaaacgcaaacgcgacacccgcgaaaaaacgncgcaccgaaaaatcgcgacgcgcgcccgacccgcaaataaaacgacgcgaaaccgccgacgaaaacgcgcgcgacgcgacgacacccgcgccgacgaaaacgcaacaacgcgaacgaaaacgcgacgaccacgtccacgcgacaaaccgccgaacacgacccacgtaccgcgaccgaaaaaacgaaaaaaaaaaaaaaaaaaaaaaaaaccgcccgcgaaaaaaaaaaaaaaccacaacgaataaaaaccaaccgaaaccgaacgcgaaacgcgtacgaactaaaaccgaaaaaacgcgcgacgacgacgtaaaaacaaaaatacgcgacgacacgaacgaaaaaacaaaaccgcgaaaaatcgtccactccactaaaacgaaaaaaaaaacgctactcacgattccaattaaaattaaacaaataacgaaaaaaaaataaaaaacgacg

SEQ ID NO: 39887 - DNA, 535 bp, Artificial Sequence
  chemically treated genomic DNA (Homo sapiens) CpG-island No: 39887
  misc_feature (85)..(85): n is either a, c, g or t
gggtatagagagggatttacgtaattatcgtatcgggttcgcggcgcggggatagagcgtaggcgcggtattcgcgaaggggcgncgtatcggagggtcgcggcgcgcgttcggttcgtaggtgaggcggcgcggggtcgtcggcgggggcgcgcgcgacgcggcggtattcgcgtcggcgagagcgtaatagcgcgggcggggacgcggcgattacgtttacgcggtagatcgtcggatacgatttacgtgtcgcggtcggagaggcggggggggggggggaaagagggggaatcgttcgcgggggagaagggaggttataacgggtggaggttagtcggggtcgggcgcggggcgcgtgcgggttagggtcggagaggcgcgcggcggcggcgtggaggtaggggtgcgcggcggtacgggcgaggggatagagtcgcgggaagtcgtttattttattgaggcggagggaagaacgttatttacggttttagttaagattgagtaggtggcggggaggggatagggggcggcg

SEQ ID NO: 39888 - DNA, 535 bp, Artificial Sequence
  chemically treated genomic DNA (Homo sapiens) CpG-island No: 39888
  misc_feature (451)..(451): n is either a, c, g or t
cgccgccccctatcccctccccgccacctactcaatcttaactaaaaccgtaaataacgttcttccctccgcctcaataaaataaacgacttcccgcgactctatcccctcgcccgtaccgccgcgcacccctacctccacgccgccgccgcgcgcctctccgaccctaacccgcacgcgccccgcgcccgaccccgactaacctccacccgttataacctcccttctcccccgcgaacgattccccctctttccccccccccccccgcctctccgaccgcgacacgtaaatcgtatccgacgatctaccgcgtaaacgtaatcgccgcgtccccgcccgcgctattacgctctcgccgacgcgaataccgccgcgtcgcgcgcgcccccgccgacgaccccgcgccgcctcacctacgaaccgaacgcgcgccgcgaccctccgatacgncgccccttcgcgaataccgcgcctacgctctatccccgcgccgcgaacccgatacgataattacgtaaatccctctctataccc

SEQ ID NO: 39889 - DNA, 642 bp, Artificial Sequence
  chemically treated genomic DNA (Homo sapiens) CpG-island No: 39889
  misc_feature (441)..(441): n is either a, c, g or t
  misc_feature (523)..(523): n is either a, c, g or t
tcgtttttttgttcggcgtatcgtcgcgggtgtgttttattatagttgaaagttcggtttcgcgtttttatttcgttttttttttttcggcggcggcggcgtttcgcgcgtttttcgtcgttatcgtcggttttttcgttttttttttcgcgggtcggtcgcggggcgtttcgttttcgcgttcgggtcgtcgtcgcgcggcgttttttcgcggcgcgtcgttttgtttttcggatttcgtattacgcggcgcgtttttcggtttcggcgcgttcggtttattggacgcgtggattcgtttgattcgtcgtcgggtcgtttcgcgattttttcgtttgggcgcgtttatcgagtatttcggcgttttacggcgcgcgggcgtcggtcgcgcgcgtcgcgtttcgtcgcgtgggcggtcgttcgtgacgagtaaattagttngcggcgcgtttcggtcgagttttttagttatattacgagtttgtattcggtacgtatattttttacggtatatcgaggtcgntaatagtattattttatcgtattcgcgatacgggttagtacgttatacgcgcggcgttcgcgagtcgcgcgagcgggcgcgttcggagttcgtcggcggttttacgtcgcgatcgcgtt

SEQ ID NO: 39890 - DNA, 642 bp, Artificial Sequence
  chemically treated genomic DNA (Homo sapiens) CpG-island No: 39890
  misc_feature (120)..(120): n is either a, c, g or t
  misc_feature (202)..(202): n is either a, c, g or t
aacgcgatcgcgacgtaaaaccgccgacgaactccgaacgcgcccgctcgcgcgactcgcgaacgccgcgcgtataacgtactaacccgtatcgcgaatacgataaaataatactattancgacctcgatataccgtaaaaaatatacgtaccgaatacaaactcgtaatataactaaaaaactcgaccgaaacgcgccgcnaactaatttactcgtcacgaacgaccgcccacgcgacgaaacgcgacgcgcgcgaccgacgcccgcgcgccgtaaaacgccgaaatactcgataaacgcgcccaaacgaaaaaatcgcgaaacgacccgacgacgaatcaaacgaatccacgcgtccaataaaccgaacgcgccgaaaccgaaaaacgcgccgcgtaatacgaaatccgaaaaacaaaacgacgcgccgcgaaaaaacgccgcgcgacgacgacccgaacgcgaaaacgaaacgccccgcgaccgacccgcgaaaaaaaaaacgaaaaaaccgacgataacgacgaaaaacgcgcgaaacgccgccgccgccgaaaaaaaaaaaacgaaataaaaacgcgaaaccgaactttcaactataataaaacacacccgcgacgatacgccgaacaaaaaaacga

SEQ ID NO: 39891 - DNA, 642 bp, Artificial Sequence
  chemically treated genomic DNA (Homo sapiens) CpG-island No: 39891
  misc_feature (120)..(120): n is either a, c, g or t
  misc_feature (202)..(202): n is either a, c, g or t
ggcgcggtcgcggcgtggggtcgtcggcgggtttcgggcgcgttcgttcgcgcggttcgcgggcgtcgcgcgtgtggcgtgttggttcgtgtcgcgggtgcggtggggtggtgttattgncggtttcggtgtgtcgtggggggtatacgtatcggatgtaggttcgtggtatggttaaggagttcggtcgaggcgcgtcgtnggttggtttgttcgttacgagcgatcgtttacgcggcggggcgcgacgcgcgcggtcggcgttcgcgcgtcgtagggcgtcgaggtattcggtgggcgcgtttagacggagaagtcgcggggcggttcggcggcgggttagacgggtttacgcgtttagtgggtcgggcgcgtcggagtcgggaggcgcgtcgcgtgatgcggggttcggggagtagggcggcgcgtcgcgggggggcgtcgcgcggcggcggttcgggcgcgggggcggggcgtttcgcggtcggttcgcgggagggggggcgggggggtcggcggtggcggcggggggcgcgcggggcgtcgtcgtcgtcggagggaggggagcgaagtgagggcgcgaggtcgggtttttagttataatgaaatatattcgcggcggtgcgtcgggtagaggaacga

SEQ ID NO: 39892 - DNA, 642 bp, Artificial Sequence
  chemically treated genomic DNA (Homo sapiens) CpG-island No: 39892
  misc_feature (441)..(441): n is either a, c, g or t
  misc_feature (523)..(523): n is either a, c, g or t
tcgttcctctacccgacgcaccgccgcgaatatatttcattataactaaaaacccgacctcgcgccctcacttcgctcccctccctccgacgacgacgacgccccgcgcgccccccgccgccaccgccgacccccccgccccccctcccgcgaaccgaccgcgaaacgccccgcccccgcgcccgaaccgccgccgcgcgacgcccccccgcgacgcgccgccctactccccgaaccccgcatcacgcgacgcgcctcccgactccgacgcgcccgacccactaaacgcgtaaacccgtctaacccgccgccgaaccgccccgcgacttctccgtctaaacgcgcccaccgaatacctcgacgccctacgacgcgcgaacgccgaccgcgcgcgtcgcgccccgccgcgtaaacgatcgctcgtaacgaacaaaccaaccnacgacgcgcctcgaccgaactccttaaccataccacgaacctacatccgatacgtataccccccacgacacaccgaaaccgncaataacaccaccccaccgcacccgcgacacgaaccaacacgccacacgcgcgacgcccgcgaaccgcgcgaacgaacgcgcccgaaacccgccgacgaccccacgccgcgaccgcgcc

SEQ ID NO: 39893 - DNA, 791 bp, Artificial Sequence
  chemically treated genomic DNA (Homo sapiens) CpG-island No: 39893
tcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttatttcggtaggtaacggcgttgatgatttatttggacgagcgaattgatgttttttcgttggatgttgggtattcgttggcgttgttacggtcggcgtttgatgatcgagcgggggtgtttgggttcgattttgaaattttttgggcgggtgaaaatttttttggcggtattgaggtttgggttggggatcgaatttgggggtttggggtcgatttggtttgggtttttcgtattgaggataagaataaaatggaatagcgcgttattttttttaatatagtcgtttttttttcgtttcgttcggttcgatttcgtttttcgtcgttcgatcggttagttattcgttatattcgagatagttttttttttatttacgtatatttttttatttatagataattcgttttataaatattttcgagatttatttt

SEQ ID NO: 39894 - DNA, 791 bp, Artificial Sequence
  chemically treated genomic DNA (Homo sapiens) CpG-island No: 39894
aaaataaatctcgaaaatatttataaaacgaattatctataaataaaaaaatatacgtaaataaaaaaaaaactatctcgaatataacgaataactaaccgatcgaacgacgaaaaacgaaatcgaaccgaacgaaacgaaaaaaaaacgactatattaaaaaaaataacgcgctattccattttattcttatcctcaatacgaaaaacccaaaccaaatcgaccccaaacccccaaattcgatccccaacccaaacctcaataccgccaaaaaaattttcacccgcccaaaaaatttcaaaatcgaacccaaacacccccgctcgatcatcaaacgccgaccgtaacaacgccaacgaatacccaacatccaacgaaaaaacatcaattcgctcgtccaaataaatcatcaacgccgttacctaccgaaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccga

SEQ ID NO: 39895 - DNA, 791 bp, Artificial Sequence
  chemically treated genomic DNA (Homo sapiens) CpG-island No: 39895
gggatgggtttcggaggtgtttgtggggcgagttatttgtgggtggaggggtgtgcgtgagtaaaaagaagattatttcgagtgtagcgggtgattggtcggtcgagcggcggggggcggggtcggatcgggcggggcggagaggaagcggttgtgttaaagggggtgacgcgttgttttattttatttttatttttagtgcgagaaatttaaattaagtcggttttaggtttttaaattcggtttttaatttaaattttaatgtcgttagaagggtttttattcgtttaaaaagttttagggtcggatttaagtattttcgttcggttattaagcgtcgatcgtggtaacgttagcgagtatttaatatttagcgaggagatattagttcgttcgtttagataggttattaacgtcgttgtttgtcggaatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcga

SEQ ID NO: 39896 - DNA, 791 bp, Artificial Sequence
  chemically treated genomic DNA (Homo sapiens) CpG-island No: 39896
tcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctattccgacaaacaacgacgttaataacctatctaaacgaacgaactaatatctcctcgctaaatattaaatactcgctaacgttaccacgatcgacgcttaataaccgaacgaaaatacttaaatccgaccctaaaactttttaaacgaataaaaacccttctaacgacattaaaatttaaattaaaaaccgaatttaaaaacctaaaaccgacttaatttaaatttctcgcactaaaaataaaaataaaataaaacaacgcgtcaccccctttaacacaaccgcttcctctccgccccgcccgatccgaccccgccccccgccgctcgaccgaccaatcacccgctacactcgaaataatcttctttttactcacgcacacccctccacccacaaataactcgccccacaaacacctccgaaacccatccc

SEQ ID NO: 39897 - DNA, 1024 bp, Artificial Sequence
  chemically treated genomic DNA (Homo sapiens) CpG-island No: 39897
tcgggtatcgcggggtttagggttcgcggggtttttgagttgaggcggtttaatgtattttttgtttttttttagatttattatgaaattcgaggtagtttgggcgattttagcggcgttcgttcgtcgtagtttttcgatcgtcggttattcgttagttacgcgcgtttagataggagggcggtcgggcgttcggcggggcggggttgtcgggggcggggtttgcgggcggggcggggcgcgggagggcggggtcggcgcggcgagcgtattagtagtattttggtttagtcgcggcggtggcgggggcgtaattagcgggtcgaggcggcggcgttagcggggttttaaatagtatttagagtcggcgcggggtagggagtgggttgtagtgatagtcggcggcggagcggtcggtttacggaggaggtgagtgcgttcgtcgtgcggagtcgcgtttgttttcgcggcggtgttcgggtttcggtcgaggcgtcggttgacgttgttttttagggtcgagttcggagtagcggtcgtcgcggaggcgcgtgagttattttaggttcgtggggtcgcgtcgttttttcggttttttgttcgcggtttcgtttttttcggtagtcggaggttttcggggtgttcgtgttgtcgtagttttttgtgtttgagtcgcgggcggcgcgggcgcggggttggtgcgcggtcggggatgcgcgcgggatcgatttttgtgtgtgcggcggcggggatcggttcggcgaagtagtcggaggtcgcgtttcggttgggaggaggtggtttagttgggtcgttgacgttgttttcgttcgcggttttcgtttgtttagaggtcgggttcgcgggcgttcggatcgcgcgtggggcgagattgtattcgcgttcgttgagatgtcggttttacgtagcgcggcggtacgaggtttataggtagtttagaggtcgttgttagaggtagatattttttcggtgattttagaggagtgttcgtggtttttgtatt

SEQ ID NO: 39898 - DNA, 1024 bp, Artificial Sequence
  chemically treated genomic DNA (Homo sapiens) CpG-island No: 39898
aatacaaaaaccacgaacactcctctaaaatcaccgaaaaaatatctacctctaacaacgacctctaaactacctataaacctcgtaccgccgcgctacgtaaaaccgacatctcaacgaacgcgaatacaatctcgccccacgcgcgatccgaacgcccgcgaacccgacctctaaacaaacgaaaaccgcgaacgaaaacaacgtcaacgacccaactaaaccacctcctcccaaccgaaacgcgacctccgactacttcgccgaaccgatccccgccgccgcacacacaaaaatcgatcccgcgcgcatccccgaccgcgcaccaaccccgcgcccgcgccgcccgcgactcaaacacaaaaaactacgacaacacgaacaccccgaaaacctccgactaccgaaaaaaacgaaaccgcgaacaaaaaaccgaaaaaacgacgcgaccccacgaacctaaaataactcacgcgcctccgcgacgaccgctactccgaactcgaccctaaaaaacaacgtcaaccgacgcctcgaccgaaacccgaacaccgccgcgaaaacaaacgcgactccgcacgacgaacgcactcacctcctccgtaaaccgaccgctccgccgccgactatcactacaacccactccctaccccgcgccgactctaaatactatttaaaaccccgctaacgccgccgcctcgacccgctaattacgcccccgccaccgccgcgactaaaccaaaatactactaatacgctcgccgcgccgaccccgccctcccgcgccccgccccgcccgcaaaccccgcccccgacaaccccgccccgccgaacgcccgaccgccctcctatctaaacgcgcgtaactaacgaataaccgacgatcgaaaaactacgacgaacgaacgccgctaaaatcgcccaaactacctcgaatttcataataaatctaaaaaaaaacaaaaaatacattaaaccgcctcaactcaaaaaccccgcgaaccctaaaccccgcgatacccga

SEQ ID NO: 39899 - DNA, 1024 bp, Artificial Sequence
  chemically treated genomic DNA (Homo sapiens) CpG-island No: 39899
agtgtaagggttacgggtatttttttggagttatcgagagaatgtttgtttttggtagcggtttttgagttgtttgtgggtttcgtgtcgtcgcgttgcgtggggtcggtattttagcgggcgcgagtgtagtttcgttttacgcgcggttcgaacgttcgcgagttcggtttttgggtaggcgggggtcgcggacgagggtaacgttagcggtttagttgggttatttttttttagtcgaagcgcggttttcggttgtttcgtcgggtcggttttcgtcgtcgtatatataagggtcggtttcgcgcgtattttcggtcgcgtattagtttcgcgttcgcgtcgttcgcgatttagatataggaagttgcggtagtacgggtatttcggaggttttcggttgtcgagggaagcggggtcgcgggtaggaggtcggaaaggcggcgcggttttacgagtttggggtggtttacgcgttttcgcggcggtcgttgtttcgggttcggttttgaagggtaacgttagtcggcgtttcggtcggggttcgggtatcgtcgcgggagtaggcgcggtttcgtacggcgggcgtatttatttttttcgtggatcggtcgtttcgtcgtcggttgttattgtagtttattttttgtttcgcgtcggttttggatgttatttaaggtttcgttggcgtcgtcgtttcggttcgttggttgcgttttcgttatcgtcgcggttgagttaggatgttgttggtgcgttcgtcgcgtcggtttcgttttttcgcgtttcgtttcgttcgtaggtttcgttttcggtagtttcgtttcgtcgagcgttcggtcgtttttttgtttgggcgcgcgtggttggcgggtggtcggcggtcgagaggttgcggcgggcgaacgtcgttggagtcgtttagattgtttcggattttataatgaatttgaggaaggataaagggtatattggatcgttttagtttagaggtttcgcggattttgggtttcgcgatgttcga

SEQ ID NO: 39900 - DNA, 1024 bp, Artificial Sequence
  chemically treated genomic DNA (Homo sapiens) CpG-island No: 39900
tcgaacatcgcgaaacccaaaatccgcgaaacctctaaactaaaacgatccaatataccctttatccttcctcaaattcattataaaatccgaaacaatctaaacgactccaacgacgttcgcccgccgcaacctctcgaccgccgaccacccgccaaccacgcgcgcccaaacaaaaaaacgaccgaacgctcgacgaaacgaaactaccgaaaacgaaacctacgaacgaaacgaaacgcgaaaaaacgaaaccgacgcgacgaacgcaccaacaacatcctaactcaaccgcgacgataacgaaaacgcaaccaacgaaccgaaacgacgacgccaacgaaaccttaaataacatccaaaaccgacgcgaaacaaaaaataaactacaataacaaccgacgacgaaacgaccgatccacgaaaaaaataaatacgcccgccgtacgaaaccgcgcctactcccgcgacgatacccgaaccccgaccgaaacgccgactaacgttacccttcaaaaccgaacccgaaacaacgaccgccgcgaaaacgcgtaaaccaccccaaactcgtaaaaccgcgccgcctttccgacctcctacccgcgaccccgcttccctcgacaaccgaaaacctccgaaatacccgtactaccgcaacttcctatatctaaatcgcgaacgacgcgaacgcgaaactaatacgcgaccgaaaatacgcgcgaaaccgacccttatatatacgacgacgaaaaccgacccgacgaaacaaccgaaaaccgcgcttcgactaaaaaaaaataacccaactaaaccgctaacgttaccctcgtccgcgacccccgcctacccaaaaaccgaactcgcgaacgttcgaaccgcgcgtaaaacgaaactacactcgcgcccgctaaaataccgaccccacgcaacgcgacgacacgaaacccacaaacaactcaaaaaccgctaccaaaaacaaacattctctcgataactccaaaaaaatacccgtaacccttacact

SEQ ID NO: 39901 - DNA, 514 bp, Artificial Sequence
  chemically treated genomic DNA (Homo sapiens) CpG-island No: 39901
  misc_feature (51)..(51): n is either a, c, g or t
  misc_feature (264)..(264): n is either a, c, g or t
  misc_feature (493)..(493): n is either a, c, g or t
tcgtacgttttttttcgacgttgatttaggaacgcgttcggcgggattttngttagttttagcgttgtcgcgttttttcgtttcgatcgttttcgtcgcgcgtttggtgttcggcgcgtttagggtcggcgcgttttgtgttcggcgttttcgggagggcgcggcggtcgcgcgcggcgggcgcgcggtggcgcgtttagtacgcgttgcgtgttttttagcgcgagtggcgttatcgttcgatcgcgcgcgttttttttttgntcgtattttcgcgttttcggtcggttttttattttttcgtttttttcgcgtttttcgtatcgtttatatcgttttagcgcggttgtttcgtgttcgtcgtcgtttatgttttcgttattttcgtttttcggtttttttcggtttgttattacgggcgtttcgtcgcgtacggggtcgttcggtgcgttagcgaattggagatataggacgtgtttcgagtattgttttntgtcgttacgtcgtcggtcga

SEQ ID NO: 39902 - DNA, 514 bp, Artificial Sequence
  chemically treated genomic DNA (Homo sapiens) CpG-island No: 39902
  misc_feature (22)..(22): n is either a, c, g or t
  misc_feature (251)..(251): n is either a, c, g or t
  misc_feature (464)..(464): n is either a, c, g or t
tcgaccgacgacgtaacgacanaaaacaatactcgaaacacgtcctatatctccaattcgctaacgcaccgaacgaccccgtacgcgacgaaacgcccgtaataacaaaccgaaaaaaaccgaaaaacgaaaataacgaaaacataaacgacgacgaacacgaaacaaccgcgctaaaacgatataaacgatacgaaaaacgcgaaaaaaacgaaaaaataaaaaaccgaccgaaaacgcgaaaatacgancaaaaaaaaaacgcgcgcgatcgaacgataacgccactcgcgctaaaaaacacgcaacgcgtactaaacgcgccaccgcgcgcccgccgcgcgcgaccgccgcgccctcccgaaaacgccgaacacaaaacgcgccgaccctaaacgcgccgaacaccaaacgcgcgacgaaaacgatcgaaacgaaaaaacgcgacaacgctaaaactaacnaaaatcccgccgaacgcgttcctaaatcaacgtcgaaaaaaaacgtacga

SEQ ID NO: 39903 - DNA, 514 bp, Artificial Sequence
  chemically treated genomic DNA (Homo sapiens) CpG-island No: 39903
  misc_feature (22)..(22): n is either a, c, g or t
  misc_feature (251)..(251): n is either a, c, g or t
  misc_feature (464)..(464): n is either a, c, g or t
tcggtcggcgacgtggcggtangaggtaatgttcgaagtacgttttatatttttagttcgttggcgtatcggacggtttcgtacgcggcgggacgttcgtggtagtaggtcgaggggggtcgaggaacgggggtgacgagggtataaacggcggcggatacggagtagtcgcgttggagcgatgtgagcgatgcggggggcgcgaggggggcggagaggtagagaatcggtcgggagcgcgagagtgcgantagaggaaaggcgcgcgcgatcgggcgatggcgttattcgcgttggaggatacgtaacgcgtgttaagcgcgttatcgcgcgttcgtcgcgcgcggtcgtcgcgttttttcgggggcgtcgggtatagggcgcgtcggttttgagcgcgtcggatattaggcgcgcgacgagggcggtcggaacgagagggcgcggtagcgttggggttggtnggggtttcgtcgagcgcgtttttgagttagcgtcgagagaggacgtgcgg

SEQ ID NO: 39904 - DNA, 514 bp, Artificial Sequence
  chemically treated genomic DNA (Homo sapiens) CpG-island No: 39904
  misc_feature (51)..(51): n is either a, c, g or t
  misc_feature (264)..(264): n is either a, c, g or t
  misc_feature (493)..(493): n is either a, c, g or t
ccgcacgtcctctctcgacgctaactcaaaaacgcgctcgacgaaaccccnaccaaccccaacgctaccgcgccctctcgttccgaccgccctcgtcgcgcgcctaatatccgacgcgctcaaaaccgacgcgccctatacccgacgcccccgaaaaaacgcgacgaccgcgcgcgacgaacgcgcgataacgcgcttaacacgcgttacgtatcctccaacgcgaataacgccatcgcccgatcgcgcgcgcctttcctctantcgcactctcgcgctcccgaccgattctctacctctccgcccccctcgcgccccccgcatcgctcacatcgctccaacgcgactactccgtatccgccgccgtttataccctcgtcacccccgttcctcgacccccctcgacctactaccacgaacgtcccgccgcgtacgaaaccgtccgatacgccaacgaactaaaaatataaaacgtacttcgaacattacctcntaccgccacgtcgccgaccga

SEQ ID NO: 39905 - DNA, 772 bp, Artificial Sequence
  chemically treated genomic DNA (Homo sapiens) CpG-island No: 39905
tttatttagtcgggagtttgcgcggttcgggttcgggagcgtttcggtgtttttcggcgtacgcggtttttgggggtttcgagtttattgttttcgggcgtttcggttcggttcgggcgatttaagttttagtttttcgggtttttacggtttttaaatttttcggggttcgggggagcgtaacgtttaggtgagcgcggtcgcgtttggttgtagttcgcggggacgtagtgtcgttataggttgttttttgtcggggcgagggtcgtttttcggttttttagaggttgaggggtcgtagcggagatcgttgggcggaggcgaaaggtttttgtcgggtttagtttatgaagttgacggtgcgattgggcgtattcggagtgaaagcgataatttcgttcgggttttgtagtttagaatttgggttaggtaggagaggttgtttaaggttcgggagtagcgacgtttgaatatttagcggcgttgtttaagttaatttttcgtagcggcggcggtttttttttttcggagttttgcggggtttatcgttttagattcgtaattgtacggtcggagtcgtagtttcgggttcggttattttttcgttttttagacgttagtagttgcgaggttgggatttcgaattttgaatttggtttcggggagtttcggttttgatcgcggcgtttttgggatattttttttagggttttttgttacgttttggaaagttttgagtttcgataatttggaaagaaattattttttataa

SEQ ID NO: 39906 - DNA, 772 bp, Artificial Sequence
  chemically treated genomic DNA (Homo sapiens) CpG-island No: 39906
ttataaaaaataatttctttccaaattatcgaaactcaaaactttccaaaacgtaacaaaaaaccctaaaaaaaatatcccaaaaacgccgcgatcaaaaccgaaactccccgaaaccaaattcaaaattcgaaatcccaacctcgcaactactaacgtctaaaaaacgaaaaaataaccgaacccgaaactacgactccgaccgtacaattacgaatctaaaacgataaaccccgcaaaactccgaaaaaaaaaaaccgccgccgctacgaaaaattaacttaaacaacgccgctaaatattcaaacgtcgctactcccgaaccttaaacaacctctcctacctaacccaaattctaaactacaaaacccgaacgaaattatcgctttcactccgaatacgcccaatcgcaccgtcaacttcataaactaaacccgacaaaaacctttcgcctccgcccaacgatctccgctacgacccctcaacctctaaaaaaccgaaaaacgaccctcgccccgacaaaaaacaacctataacgacactacgtccccgcgaactacaaccaaacgcgaccgcgctcacctaaacgttacgctcccccgaaccccgaaaaatttaaaaaccgtaaaaacccgaaaaactaaaacttaaatcgcccgaaccgaaccgaaacgcccgaaaacaataaactcgaaacccccaaaaaccgcgtacgccgaaaaacaccgaaacgctcccgaacccgaaccgcgcaaactcccgactaaataaa

SEQ ID NO: 39907 - DNA, 772 bp, Artificial Sequence
  chemically treated genomic DNA (Homo sapiens) CpG-island No: 39907
ttgtgaggagtgatttttttttagattatcgagatttaagattttttagaacgtggtaaagagttttggaagaaatgttttaggaacgtcgcggttaggatcgaggtttttcggggttaggtttagggttcgaggttttagtttcgtaattgttggcgtttggagggcgggagagtggtcgggttcgaagttgcggtttcgatcgtatagttgcgagtttggggcggtgggtttcgtagagtttcgggggaagggagtcgtcgtcgttgcggggaattggtttgggtaacgtcgttgagtgtttaaacgtcgttgttttcgggttttgggtagttttttttatttgatttaaattttgggttgtaaagttcgggcgaagttgtcgtttttatttcgaatacgtttagtcgtatcgttaattttataggttgggttcggtagaggtttttcgttttcgtttagcggttttcgttgcggttttttagtttttggagagtcggggggcggttttcgtttcggtagaaagtaatttgtggcggtattgcgttttcgcgagttataattagacgcggtcgcgtttatttgggcgttgcgttttttcgagtttcggagagtttagaagtcgtaaaagttcggggagttggagtttaaatcgttcggatcgggtcggggcgttcgaaagtagtgaattcgagatttttaggaatcgcgtgcgtcgggaggtatcgggacgttttcgggttcgagtcgcgtaggttttcggttgggtggg

SEQ ID NO: 39908 - DNA, 772 bp, Artificial Sequence
  chemically treated genomic DNA (Homo sapiens) CpG-island No: 39908
cccacccaaccgaaaacctacgcgactcgaacccgaaaacgtcccgatacctcccgacgcacgcgattcctaaaaatctcgaattcactactttcgaacgccccgacccgatccgaacgatttaaactccaactccccgaacttttacgacttctaaactctccgaaactcgaaaaaacgcaacgcccaaataaacgcgaccgcgtctaattataactcgcgaaaacgcaataccgccacaaattactttctaccgaaacgaaaaccgccccccgactctccaaaaactaaaaaaccgcaacgaaaaccgctaaacgaaaacgaaaaacctctaccgaacccaacctataaaattaacgatacgactaaacgtattcgaaataaaaacgacaacttcgcccgaactttacaacccaaaatttaaatcaaataaaaaaaactacccaaaacccgaaaacaacgacgtttaaacactcaacgacgttacccaaaccaattccccgcaacgacgacgactcccttcccccgaaactctacgaaacccaccgccccaaactcgcaactatacgatcgaaaccgcaacttcgaacccgaccactctcccgccctccaaacgccaacaattacgaaactaaaacctcgaaccctaaacctaaccccgaaaaacctcgatcctaaccgcgacgttcctaaaacatttcttccaaaactctttaccacgttctaaaaaatcttaaatctcgataatctaaaaaaaaatcactcctcacaa

SEQ ID NO: 39909 - DNA, 502 bp, Artificial Sequence
  chemically treated genomic DNA (Homo sapiens) CpG-island No: 39909
ttcgatttcgtagtttttttattatttattttgtaaagtcgagttcggaaatgagcggttcgaggttcgaggtggggcgtgagtgacgtgtagaggtttaagcgagcgttgtaaggagcgagggttaaaggagttttcggcgtttattttgtttttagttttcgtatttttcgtttcgtttttttgggttatgtaatttacgcgaaattcgaagttaggttttttaaagcggttttggattttcgacgtttgttagattgcggcgtgcggttaggtttagcggcgttcgggtaattaagcgtcgattttagtttttgttcgcgtttttttagacgtatggattcggttttcgttttatttcggtttcgcgggtttaaaattttattttcggttcgggttttatgttttaattttttttgttcgggttttattttttcgttttcgggttcgggttttatttttttgttttttcgaatcggagttttttttattatttacgggt

SEQ ID NO: 39910 - DNA, 502 bp, Artificial Sequence
  chemically treated genomic DNA (Homo sapiens) CpG-island No: 39910
acccgtaaataataaaaaaaactccgattcgaaaaaacaaaaaaataaaacccgaacccgaaaacgaaaaaataaaacccgaacaaaaaaaattaaaacataaaacccgaaccgaaaataaaattttaaacccgcgaaaccgaaataaaacgaaaaccgaatccatacgtctaaaaaaacgcgaacaaaaactaaaatcgacgcttaattacccgaacgccgctaaacctaaccgcacgccgcaatctaacaaacgtcgaaaatccaaaaccgctttaaaaaacctaacttcgaatttcgcgtaaattacataacccaaaaaaacgaaacgaaaaatacgaaaactaaaaacaaaataaacgccgaaaactcctttaaccctcgctccttacaacgctcgcttaaacctctacacgtcactcacgccccacctcgaacctcgaaccgctcatttccgaactcgactttacaaaataaataataaaaaaactacgaaatcgaa

SEQ ID NO: 39911 - DNA, 502 bp, Artificial Sequence
  chemically treated genomic DNA (Homo sapiens) CpG-island No: 39911
gttcgtgggtggtgaggggggtttcggttcggggaagtaagggggtgaggttcgggttcgagggcgagagagtgaggttcgggtaaagagggttgaggtatgaaattcgggtcgggagtgaggttttgggttcgcggggtcggggtgaggcggaggtcgaatttatgcgtttgaggagacgcgggtaagagttggggtcggcgtttgattattcggacgtcgttggatttggtcgtacgtcgtaatttagtaggcgtcggggatttagggtcgttttgaggagtttggtttcggatttcgcgtaggttgtatggtttaaggggacggggcggaaagtgcggaggttgaggataaaatgggcgtcggagatttttttagttttcgttttttgtagcgttcgtttgggtttttgtacgttatttacgttttatttcggatttcgggtcgtttattttcgggttcggttttgtaaggtgggtggtaagggggttacgggatcgag

SEQ ID NO: 39912 - DNA, 502 bp, Artificial Sequence
  chemically treated genomic DNA (Homo sapiens) CpG-island No: 39912
ctcgatcccgtaacccccttaccacccaccttacaaaaccgaacccgaaaataaacgacccgaaatccgaaataaaacgtaaataacgtacaaaaacccaaacgaacgctacaaaaaacgaaaactaaaaaaatctccgacgcccattttatcctcaacctccgcactttccgccccgtccccttaaaccatacaacctacgcgaaatccgaaaccaaactcctcaaaacgaccctaaatccccgacgcctactaaattacgacgtacgaccaaatccaacgacgtccgaataatcaaacgccgaccccaactcttacccgcgtctcctcaaacgcataaattcgacctccgcctcaccccgaccccgcgaacccaaaacctcactcccgacccgaatttcatacctcaaccctctttacccgaacctcactctctcgccctcgaacccgaacctcacccccttacttccccgaaccgaaacccccctcaccacccacgaac

SEQ ID NO: 39913 - DNA, 714 bp, Artificial Sequence
  chemically treated genomic DNA (Homo sapiens) CpG-island No: 39913
aggtcgtataggagcgggtcgtcggcgtcgagtagtaggagtaggcggcggcggcgtagcgtttgttcgtttagggtttcgacgtcgtagtcgacgaagtagagcggtaggagtagcgcggttaggacgatgggcgtgtgcgcgcggtgtaggcgttgtagttagtggcggtttaggcgcgttagcgagtttttgaaggggtgtagaaaagtgtcgtatagtacggtttagagtagcggtcgtaggaaggtttttaggatgaagtagattagtattgcggcgtcgtagtataggtatacgaatagtacggtttcggtgttgtagaaggtttgtttaatgggtttgtcgaagcgtagcgttagcgtcgcgggtttcggggttttttcgttatcgttattcggttcgatcgcgcgcgggattcgcggcgtcggttcgggagagtttcgtaggtttggcgcgtttttagggtcgtcgtcgtcggttatcgttttttcgttatagtcgttttcgaggggcggtaatgggagtcgggttagaaacgcgggcgggaggtagggcgggaggcgcgcgagattgtgggagttgtagtttttcgttggtttatagatttattaagcgtttgtaggaaattataattttcgaaggggaaatggggaaaacgttttcgtttttttggtgttcgtaaggttttgttaataagtttgtagggtttat

SEQ ID NO: 39914 - DNA, 714 bp, Artificial Sequence
  chemically treated genomic DNA (Homo sapiens) CpG-island No: 39914
ataaaccctacaaacttattaacaaaaccttacgaacaccaaaaaaacgaaaacgttttccccatttccccttcgaaaattataatttcctacaaacgcttaataaatctataaaccaacgaaaaactacaactcccacaatctcgcgcgcctcccgccctacctcccgcccgcgtttctaacccgactcccattaccgcccctcgaaaacgactataacgaaaaaacgataaccgacgacgacgaccctaaaaacgcgccaaacctacgaaactctcccgaaccgacgccgcgaatcccgcgcgcgatcgaaccgaataacgataacgaaaaaaccccgaaacccgcgacgctaacgctacgcttcgacaaacccattaaacaaaccttctacaacaccgaaaccgtactattcgtatacctatactacgacgccgcaatactaatctacttcatcctaaaaaccttcctacgaccgctactctaaaccgtactatacgacacttttctacaccccttcaaaaactcgctaacgcgcctaaaccgccactaactacaacgcctacaccgcgcgcacacgcccatcgtcctaaccgcgctactcctaccgctctacttcgtcgactacgacgtcgaaaccctaaacgaacaaacgctacgccgccgccgcctactcctactactcgacgccgacgacccgctcctatacgacct

SEQ ID NO: 39915 - DNA, 714 bp, Artificial Sequence
  chemically treated genomic DNA (Homo sapiens) CpG-island No: 39915
atagattttgtaaatttgttagtaggattttgcggatattaaggaggcggaggcgttttttttatttttttttcgggagttgtagttttttgtaagcgtttggtgggtttgtaaattagcggggaattataatttttataatttcgcgcgtttttcgttttgtttttcgttcgcgtttttagttcgatttttattatcgtttttcgggggcggttgtggcggaggaacgatggtcgacggcggcggttttaaggacgcgttaagtttgcggagttttttcgggtcggcgtcgcgggtttcgcgcgcggtcgggtcgagtggcggtggcggggagatttcgggattcgcggcgttggcgttgcgtttcgataagtttattaagtaggttttttataatatcggggtcgtgttgttcgtgtgtttgtgttgcggcgtcgtagtgttggtttattttattttggaggtttttttgcggtcgttgttttgggtcgtgttatgcggtatttttttgtatttttttaagagttcgttgacgcgtttgggtcgttattggttgtagcgtttgtatcgcgcgtatacgtttatcgttttggtcgcgttgtttttgtcgttttgtttcgtcgattacggcgtcgaggttttgggcgagtaggcgttgcgtcgtcgtcgtttgtttttgttgttcggcgtcggcggttcgtttttgtacggttt

SEQ ID NO: 39916 - DNA, 714 bp, Artificial Sequence
  chemically treated genomic DNA (Homo sapiens) CpG-island No: 39916
aaaccgtacaaaaacgaaccgccgacgccgaacaacaaaaacaaacgacgacgacgcaacgcctactcgcccaaaacctcgacgccgtaatcgacgaaacaaaacgacaaaaacaacgcgaccaaaacgataaacgtatacgcgcgatacaaacgctacaaccaataacgacccaaacgcgtcaacgaactcttaaaaaaatacaaaaaaataccgcataacacgacccaaaacaacgaccgcaaaaaaacctccaaaataaaataaaccaacactacgacgccgcaacacaaacacacgaacaacacgaccccgatattataaaaaacctacttaataaacttatcgaaacgcaacgccaacgccgcgaatcccgaaatctccccgccaccgccactcgacccgaccgcgcgcgaaacccgcgacgccgacccgaaaaaactccgcaaacttaacgcgtccttaaaaccgccgccgtcgaccatcgttcctccgccacaaccgcccccgaaaaacgataataaaaatcgaactaaaaacgcgaacgaaaaacaaaacgaaaaacgcgcgaaattataaaaattataattccccgctaatttacaaacccaccaaacgcttacaaaaaactacaactcccgaaaaaaaaataaaaaaaacgcctccgcctccttaatatccgcaaaatcctactaacaaatttacaaaatctat

SEQ ID NO: 39917 - DNA, 814 bp, Artificial Sequence
  chemically treated genomic DNA (Homo sapiens) CpG-island No: 39917
gcgggaggcgggacgacggttattgatttgttagcgtgacgtcggtttgcgattggttagtgtcgttttgggcgtgtcggtaggacggggttgcgacggttttttataggttggtatagaaaggggcggggaaataagagtgtaacgttattaatcggtatgcgggacgtaacgtaattttttttttcgattggttcgtgaagttcgggaggtcgttgggggttcgattttgggatagaacgtttgttttttattggttaatatttttcgggtcgggtaatgtggtttttcgaggttgtttgcgattggtgaacgcgtcgcggttcggggcggatttgcggattgaagatttttatgcgattggtcggggagtcggaggggcgggtaatttgggatcgatagtgattcgcgattggtcggcgcggcgaaagtagagcggcgcgtcggttttttggtttttgagggcgatggcgcggggtggttggcgtcggttacgtcgtttgttattcgcggggtagtttttattttagggtcgcgcgttgttcgttattaatacgttgggttgcggcgcgtttatggcggtcggtgatggcgtgcgttagttttgggagattcgcgttcggttcggttaggttttcgatttacggcgtttcggtgaggacgttacgttgtttagttttttatttcgggcgatttttgatttcgatattcgattgcgggtcgtgatttttgattcgtggttttagtttttcgtaggatttttgttttgatcgcgttttttttcgggtgtttgttttttcgtagttttgggttt

SEQ ID NO: 39918 - DNA, 814 bp, Artificial Sequence
  chemically treated genomic DNA (Homo sapiens) CpG-island No: 39918
aaacccaaaactacgaaaaaacaaacacccgaaaaaaaacgcgatcaaaacaaaaatcctacgaaaaactaaaaccacgaatcaaaaatcacgacccgcaatcgaatatcgaaatcaaaaatcgcccgaaataaaaaactaaacaacgtaacgtcctcaccgaaacgccgtaaatcgaaaacctaaccgaaccgaacgcgaatctcccaaaactaacgcacgccatcaccgaccgccataaacgcgccgcaacccaacgtattaataacgaacaacgcgcgaccctaaaataaaaactaccccgcgaataacaaacgacgtaaccgacgccaaccaccccgcgccatcgccctcaaaaaccaaaaaaccgacgcgccgctctactttcgccgcgccgaccaatcgcgaatcactatcgatcccaaattacccgcccctccgactccccgaccaatcgcataaaaatcttcaatccgcaaatccgccccgaaccgcgacgcgttcaccaatcgcaaacaacctcgaaaaaccacattacccgacccgaaaaatattaaccaataaaaaacaaacgttctatcccaaaatcgaacccccaacgacctcccgaacttcacgaaccaatcgaaaaaaaaaattacgttacgtcccgcataccgattaataacgttacactcttatttccccgcccctttctataccaacctataaaaaaccgtcgcaaccccgtcctaccgacacgcccaaaacgacactaaccaatcgcaaaccgacgtcacgctaacaaatcaataaccgtcgtcccgcctcccgc

SEQ ID NO: 39919 - DNA, 814 bp, Artificial Sequence
  chemically treated genomic DNA (Homo sapiens) CpG-island No: 39919
agatttagagttgcggggagatagatattcggggagaggcgcggttagggtaagggttttgcgggggattgaggttacgggttaggggttacggttcgtagtcgggtgtcgggattaaaggtcgttcggggtgaaggattaagtagcgtggcgtttttatcggagcgtcgtgggtcgaaaatttggtcgggtcgggcgcggattttttaggattggcgtacgttattatcggtcgttatgagcgcgtcgtagtttagcgtgttagtgacgagtagcgcgcggttttggaatagaagttgtttcgcggataataggcggcgtagtcggcgttagttatttcgcgttatcgtttttaggaattaaggaatcggcgcgtcgttttgttttcgtcgcgtcgattagtcgcgagttattgtcgattttaaattgttcgttttttcggtttttcggttaatcgtataaggatttttagttcgtaggttcgtttcgagtcgcgacgcgtttattaatcgtaggtagtttcggggagttatattgttcggttcgaagagtattgattaataaaaggtaggcgttttattttaaggtcgagtttttaacgatttttcgagttttacggattaatcggaaaaaagaattgcgttacgtttcgtatgtcgattggtaacgttgtatttttgttttttcgtttttttttgtgttagtttatgggaaatcgtcgtagtttcgttttatcgatacgtttaggacggtattggttagtcgtagatcggcgttacgttggtaaattagtgatcgtcgtttcgtttttcgt

SEQ ID NO: 39920 - DNA, 814 bp, Artificial Sequence
  chemically treated genomic DNA (Homo sapiens) CpG-island No: 39920
acgaaaaacgaaacgacgatcactaatttaccaacgtaacgccgatctacgactaaccaataccgtcctaaacgtatcgataaaacgaaactacgacgatttcccataaactaacacaaaaaaaaacgaaaaaacaaaaatacaacgttaccaatcgacatacgaaacgtaacgcaattcttttttccgattaatccgtaaaactcgaaaaatcgttaaaaactcgaccttaaaataaaacgcctaccttttattaatcaatactcttcgaaccgaacaatataactccccgaaactacctacgattaataaacgcgtcgcgactcgaaacgaacctacgaactaaaaatccttatacgattaaccgaaaaaccgaaaaaacgaacaatttaaaatcgacaataactcgcgactaatcgacgcgacgaaaacaaaacgacgcgccgattccttaattcctaaaaacgataacgcgaaataactaacgccgactacgccgcctattatccgcgaaacaacttctattccaaaaccgcgcgctactcgtcactaacacgctaaactacgacgcgctcataacgaccgataataacgtacgccaatcctaaaaaatccgcgcccgacccgaccaaattttcgacccacgacgctccgataaaaacgccacgctacttaatccttcaccccgaacgacctttaatcccgacacccgactacgaaccgtaacccctaacccgtaacctcaatcccccgcaaaacccttaccctaaccgcgcctctccccgaatatctatctccccgcaactctaaatct

SEQ ID NO: 39921 - DNA, 611 bp, Artificial Sequence
  chemically treated genomic DNA (Homo sapiens) CpG-island No: 39921
cgttcgcgggttacgaggcggggagcgacggttatttttttcggttattcggagtatttgggcgggaacgggtagttcgcgggagagacgggtttttgggcgagggttgcgttttagtcgttttgttttttagttttcgaggtttcgcgtgttacgtgttagtatcgttcgggggcgttagtatgattcgaggttgtaggaatcgtgaattttttgtttcgcgggtttaggtgatcgcgggcggcgttttttcgcgcgcggggggcggggtttttttcggttgtttatttagttattatagcgacgtaaaatggtgttcgttaggcgttttaggacggttttttgagggattggagggtttcgatagacggaaagtttgtttcgttttttggtcggtataggtacgacggcggggagtttagaagtttcgaattttaagggtcgaagtatagttaaatattttacggaatttaataaatgtttgtggggagaacgtcgaaaacgcggggaggcggggttggcgtatagttattttttcgcgatatttaagtgacgttttatagtaagtacgtgttttagattttaatttttagttagttttttacgttata

SEQ ID NO: 39922 - DNA, 611 bp, Artificial Sequence
  chemically treated genomic DNA (Homo sapiens) CpG-island No: 39922
tataacgtaaaaaactaactaaaaattaaaatctaaaacacgtacttactataaaacgtcacttaaatatcgcgaaaaaataactatacgccaaccccgcctccccgcgttttcgacgttctccccacaaacatttattaaattccgtaaaatatttaactatacttcgacccttaaaattcgaaacttctaaactccccgccgtcgtacctataccgaccaaaaaacgaaacaaactttccgtctatcgaaaccctccaatccctcaaaaaaccgtcctaaaacgcctaacgaacaccattttacgtcgctataataactaaataaacaaccgaaaaaaaccccgccccccgcgcgcgaaaaaacgccgcccgcgatcacctaaacccgcgaaacaaaaaattcacgattcctacaacctcgaatcatactaacgcccccgaacgatactaacacgtaacacgcgaaacctcgaaaactaaaaaacaaaacgactaaaacgcaaccctcgcccaaaaacccgtctctcccgcgaactacccgttcccgcccaaatactccgaataaccgaaaaaaataaccgtcgctccccgcctcgtaacccgcgaacg

SEQ ID NO: 39923 - DNA, 611 bp, Artificial Sequence
  chemically treated genomic DNA (Homo sapiens) CpG-island No: 39923
tataacgtagaagattgattgaaggttaaagtttagaatacgtgtttattgtgagacgttatttagatgtcgcgagagggtgattgtgcgttagtttcgttttttcgcgttttcggcgttttttttataaatatttgttaagtttcgtggggtgtttggttgtgtttcggtttttggagttcgaaatttttgagtttttcgtcgtcgtatttgtgtcggttaaggggcggggtaggtttttcgtttgtcggggttttttagttttttaggaagtcgttttgggacgtttagcggatattattttacgtcgttgtggtagttgagtgaatagtcggggggagtttcgtttttcgcgcgcgggagagcgtcgttcgcggttatttgggttcgcggggtagagagtttacggtttttgtagtttcgggttatgttgacgttttcgggcggtgttaatacgtaatacgcgggatttcgagagttaagaagtagggcgattaagacgtagttttcgtttaggagttcgtttttttcgcgagttattcgttttcgtttaagtatttcgggtaatcgaggggagtgatcgtcgtttttcgtttcgtggttcgcgggcg

SEQ ID NO: 39924 - DNA, 611 bp, Artificial Sequence
  chemically treated genomic DNA (Homo sapiens) CpG-island No: 39924
cgcccgcgaaccacgaaacgaaaaacgacgatcactcccctcgattacccgaaatacttaaacgaaaacgaataactcgcgaaaaaaacgaactcctaaacgaaaactacgtcttaatcgccctacttcttaactctcgaaatcccgcgtattacgtattaacaccgcccgaaaacgtcaacataacccgaaactacaaaaaccgtaaactctctaccccgcgaacccaaataaccgcgaacgacgctctcccgcgcgcgaaaaacgaaactccccccgactattcactcaactaccacaacgacgtaaaataatatccgctaaacgtcccaaaacgacttcctaaaaaactaaaaaaccccgacaaacgaaaaacctaccccgccccttaaccgacacaaatacgacgacgaaaaactcaaaaatttcgaactccaaaaaccgaaacacaaccaaacaccccacgaaacttaacaaatatttataaaaaaaacgccgaaaacgcgaaaaaacgaaactaacgcacaatcaccctctcgcgacatctaaataacgtctcacaataaacacgtattctaaactttaaccttcaatcaatcttctacgttata

SEQ ID NO: 39925 - DNA, 527 bp, Artificial Sequence
  chemically treated genomic DNA (Homo sapiens) CpG-island No: 39925
gaggattgcggggcgggattttgtgtcgcggcggagtttaagatggcggcgtgcggtttcgttgtgtgaaacgagcgcggggcggcgggttatttagtttcgcggagacgattttcgacgattcgtaataatgaagggaaaagagcgttcgttagtgaaggttaaacgttttcgtggtggtgaggattcgatttttcgcggtgagcggagtaagaagttagggggttttggtggtagtaatgggagtagtagcggaaagatcgatagcggcggtgggtcgcggcggagtttttatttggataagtttagtagtcgaggtggtagtcgcgagtatgatatcggtgggggtagttttagtagtcgtttgtatagttatagtttttcgagtattaaaaatttttcgggcgggggcgagtcgcgtagtagttttcggggtggaggcggggagttacgtttttttggggtcgtttttttagttttcggcggcggggacggcgcggaatataagattttgaagataagcgagt

SEQ ID NO: 39926 - DNA, 527 bp, Artificial Sequence
  chemically treated genomic DNA (Homo sapiens) CpG-island No: 39926
actcgcttatcttcaaaatcttatattccgcgccgtccccgccgccgaaaactaaaaaaacgaccccaaaaaaacgtaactccccgcctccaccccgaaaactactacgcgactcgcccccgcccgaaaaatttttaatactcgaaaaactataactatacaaacgactactaaaactacccccaccgatatcatactcgcgactaccacctcgactactaaacttatccaaataaaaactccgccgcgacccaccgccgctatcgatctttccgctactactcccattactaccaccaaaaccccctaacttcttactccgctcaccgcgaaaaatcgaatcctcaccaccacgaaaacgtttaaccttcactaacgaacgctcttttcccttcattattacgaatcgtcgaaaatcgtctccgcgaaactaaataacccgccgccccgcgctcgtttcacacaacgaaaccgcacgccgccatcttaaactccgccgcgacacaaaatcccgccccgcaatcctc

SEQ ID NO: 39927 - DNA, 527 bp, Artificial Sequence
  chemically treated genomic DNA (Homo sapiens) CpG-island No: 39927
attcgtttatttttagagttttgtatttcgcgtcgttttcgtcgtcgggagttgaggaggcggttttagaggaacgtgatttttcgtttttatttcgggagttgttgcgcgattcgttttcgttcgaagaatttttggtgttcggggagttataattatgtaagcggttattggagttgtttttatcggtattatattcgcggttgttatttcgattgttggatttgtttaggtggagatttcgtcgcgatttatcgtcgttatcggttttttcgttgttgtttttattgttgttattagagttttttaattttttgtttcgtttatcgcgggaagtcgagtttttattattacgggagcgtttggtttttattggcgagcgtttttttttttttattgttgcgggtcgtcggaggtcgttttcgcggagttgagtaattcgtcgtttcgcgttcgttttatatagcggaatcgtacgtcgttattttggatttcgtcgcggtatagggtttcgtttcgtagttttt

SEQ ID NO: 39928 - DNA, 527 bp, Artificial Sequence
  chemically treated genomic DNA (Homo sapiens) CpG-island No: 39928
aaaaactacgaaacgaaaccctataccgcgacgaaatccaaaataacgacgtacgattccgctatataaaacgaacgcgaaacgacgaattactcaactccgcgaaaacgacctccgacgacccgcaacaataaaaaaaaaaaaacgctcgccaataaaaaccaaacgctcccgtaataataaaaactcgacttcccgcgataaacgaaacaaaaaattaaaaaactctaataacaacaataaaaacaacaacgaaaaaaccgataacgacgataaatcgcgacgaaatctccacctaaacaaatccaacaatcgaaataacaaccgcgaatataataccgataaaaacaactccaataaccgcttacataattataactccccgaacaccaaaaattcttcgaacgaaaacgaatcgcgcaacaactcccgaaataaaaacgaaaaatcacgttcctctaaaaccgcctcctcaactcccgacgacgaaaacgacgcgaaatacaaaactctaaaaataaacgaat

SEQ ID NO: 39929 - DNA, 629 bp, Artificial Sequence
  chemically treated genomic DNA (Homo sapiens) CpG-island No: 39929
gatagcgttcggtcgttgttcgggttttaggcgcggtcggacggtttagtttggagggttcggggcggaggttcgggggggtgcgcgcgttcggggttcggttttttattcgtttttttttcgttcgtagtcgtagggtcgtaggtagttatggcgtttagtcggaatggtatggttttgaagttttatttttataaggattggtagcggcgcgtggttacgtggtttaattagtcggttcgtaagattcgtaggtgagttttgcgttcggggttgtttttggggttcgtgttcgcggttgcgttttggtttgcgggtggtcgatgttagggcggggggcgttgtttgtaatcgtcgcggagcgttggtttggcggttttaggtaagggtgatcgtcgttgcgtttttttttattagacgtaagggttcggtaagttaaggcgcgtcgtatcgtttcgcgtttcgcgtcgggttttattcggtttatcgtgcgttgttttacggttcggtattatacgaaggtgcgcgtcggtcgcggttttagtttggaggagttttagggtgagtattggtagcgttgcggtgttaggaaggtttcgaagttttttttgttggttttagtcgcgtga

SEQ ID NO: 39930 - DNA, 629 bp, Artificial Sequence
  chemically treated genomic DNA (Homo sapiens) CpG-island No: 39930
tcacgcgactaaaaccaacaaaaaaaacttcgaaaccttcctaacaccgcaacgctaccaatactcaccctaaaactcctccaaactaaaaccgcgaccgacgcgcaccttcgtataataccgaaccgtaaaacaacgcacgataaaccgaataaaacccgacgcgaaacgcgaaacgatacgacgcgccttaacttaccgaacccttacgtctaataaaaaaaaacgcaacgacgatcacccttacctaaaaccgccaaaccaacgctccgcgacgattacaaacaacgccccccgccctaacatcgaccacccgcaaaccaaaacgcaaccgcgaacacgaaccccaaaaacaaccccgaacgcaaaactcacctacgaatcttacgaaccgactaattaaaccacgtaaccacgcgccgctaccaatccttataaaaataaaacttcaaaaccataccattccgactaaacgccataactacctacgaccctacgactacgaacgaaaaaaaaacgaataaaaaaccgaaccccgaacgcgcgcacccccccgaacctccgccccgaaccctccaaactaaaccgtccgaccgcgcctaaaacccgaacaacgaccgaacgctatc

SEQ ID NO: 39931 - DNA, 629 bp, Artificial Sequence
  chemically treated genomic DNA (Homo sapiens) CpG-island No: 39931
ttacgcgattgaggttaatagaggggatttcggggtttttttgatatcgtagcgttgttagtatttattttggagtttttttaggttgaagtcgcggtcggcgcgtattttcgtgtggtatcgaatcgtggggtagcgtacgatgggtcggatgggattcgacgcggggcgcggagcgatgcggcgcgttttggtttgtcgggtttttacgtttggtggagagaagcgtagcggcggttatttttgtttaaggtcgttaggttagcgtttcgcgacggttgtagatagcgtttttcgttttggtatcggttattcgtaagttaaggcgtagtcgcgggtacgagttttaggggtagtttcgagcgtagggtttatttgcggattttacgggtcggttggttgaattacgtggttacgcgtcgttgttagtttttgtggaagtggggttttaagattatgttatttcggttgggcgttatggttgtttacggttttgcggttgcggacgagaggggagcgagtgagaggtcggatttcgggcgcgcgtattttttcgggttttcgtttcgaattttttagattgggtcgttcggtcgcgtttagagttcgggtagcggtcgaacgttgtt

SEQ ID NO: 39932 - DNA, 629 bp, Artificial Sequence
  chemically treated genomic DNA (Homo sapiens) CpG-island No: 39932
aacaacgttcgaccgctacccgaactctaaacgcgaccgaacgacccaatctaaaaaattcgaaacgaaaacccgaaaaaatacgcgcgcccgaaatccgacctctcactcgctcccctctcgtccgcaaccgcaaaaccgtaaacaaccataacgcccaaccgaaataacataatcttaaaaccccacttccacaaaaactaacaacgacgcgtaaccacgtaattcaaccaaccgacccgtaaaatccgcaaataaaccctacgctcgaaactacccctaaaactcgtacccgcgactacgccttaacttacgaataaccgataccaaaacgaaaaacgctatctacaaccgtcgcgaaacgctaacctaacgaccttaaacaaaaataaccgccgctacgcttctctccaccaaacgtaaaaacccgacaaaccaaaacgcgccgcatcgctccgcgccccgcgtcgaatcccatccgacccatcgtacgctaccccacgattcgataccacacgaaaatacgcgccgaccgcgacttcaacctaaaaaaactccaaaataaatactaacaacgctacgatatcaaaaaaaccccgaaatcccctctattaacctcaatcgcgtaa

SEQ ID NO: 39933 - DNA, 919 bp, Artificial Sequence
  chemically treated genomic DNA (Homo sapiens) CpG-island No: 39933
tatattttcgcggtcgcggagtcgggagcgatttataaaaggttttcgcgttagcggcgtgcgttattatggcgatcgcgcgtcgcgtagtcgcgtttcgtttttttggcgggatcggttattattttttcgcgagagtatttcgtgcgatcggaagtggggcggcgatttcggaagttttcgtcgggtgtagtttggtcggttcgatcgtcgtcgggatttgatatcgttcggagttggcgtttttttttttttttcgagtgttgtttttgttattgtggttatggacggtaagaggtcgcggtcgtttttcggggattcgcgcgcggggcggggtcgttttttttattggcgtgggtttcgtttatttggggtcgcgggtaggatttaggagagttcgggtttcgatcgtcgatttttcgggattttatttttagggtttcgattatcgatttgggattttttttttcggtcgtcgtttttcgattttcgattcggattttatttttagggtttcgattatcgatttgggattttttttttcgagtttcgtttttcgatattcgattcggaattttttttttagggtttagattattaattcgggattttttttttcgggtttcgattttcgattttcgattcggaattttttttttagggtttttattatcgattcgggattttttttttcgggtttcgattttcgattatcgatcgggattttttttaggttttcgatttttaattcgagattttttatttcgggtttcgattttcgattcgggatttttttttttaggtttcgattttcgattttcgattcgggatttttttttcggggtttttatttttaaattttaattcggtatgtttttttcggggtttcgatttttgatttttaattatggattcggga

SEQ ID NO: 39934 - DNA, 919 bp, Artificial Sequence
  chemically treated genomic DNA (Homo sapiens) CpG-island No: 39934
tcccgaatccataattaaaaatcaaaaatcgaaaccccgaaaaaaacataccgaattaaaatttaaaaataaaaaccccgaaaaaaaaatcccgaatcgaaaatcgaaaatcgaaacctaaaaaaaaaaatcccgaatcgaaaatcgaaacccgaaataaaaaatctcgaattaaaaatcgaaaacctaaaaaaaatcccgatcgataatcgaaaatcgaaacccgaaaaaaaaaatcccgaatcgataataaaaaccctaaaaaaaaaattccgaatcgaaaatcgaaaatcgaaacccgaaaaaaaaaatcccgaattaataatctaaaccctaaaaaaaaaattccgaatcgaatatcgaaaaacgaaactcgaaaaaaaaaatcccaaatcgataatcgaaaccctaaaaataaaatccgaatcgaaaatcgaaaaacgacgaccgaaaaaaaaaatcccaaatcgataatcgaaaccctaaaaataaaatcccgaaaaatcgacgatcgaaacccgaactctcctaaatcctacccgcgaccccaaataaacgaaacccacgccaataaaaaaaacgaccccgccccgcgcgcgaatccccgaaaaacgaccgcgacctcttaccgtccataaccacaataacaaaaacaacactcgaaaaaaaaaaaaaaacgccaactccgaacgatatcaaatcccgacgacgatcgaaccgaccaaactacacccgacgaaaacttccgaaatcgccgccccacttccgatcgcacgaaatactctcgcgaaaaaataataaccgatcccgccaaaaaaacgaaacgcgactacgcgacgcgcgatcgccataataacgcacgccgctaacgcgaaaaccttttataaatcgctcccgactccgcgaccgcgaaaatata

SEQ ID NO: 39935 - DNA, 919 bp, Artificial Sequence
  chemically treated genomic DNA (Homo sapiens) CpG-island No: 39935
tttcgggtttatggttgggggttagaggtcgaggtttcggggaaggtatatcgggttgagatttggggatggaggtttcggggaaggggtttcgaatcgggggtcggggatcgaggtttggggggaggggtttcgggtcgagggtcgaggttcggggtaaaggatttcgggttgggggtcgggggtttgggaagggtttcggtcggtggtcgggggtcgaggttcgggagaaggggtttcgggtcggtggtagaggttttggggaaggggtttcgggtcggggatcgagggtcgaggttcgggaaaaggggtttcgggttggtggtttaggttttggggaaggggtttcgggtcgggtatcgggggacgaggttcgggaaaaggggttttaggtcggtggtcgaggttttggggatggggttcgggtcggggatcgggggacgacgatcgggaaaaggggttttaggtcggtggtcgaggttttggggatggggtttcgggggatcgacggtcgaggttcgagtttttttgagttttgttcgcggttttaggtgggcggagtttacgttagtgggagaagcggtttcgtttcgcgcgcgagttttcggaggacggtcgcgattttttatcgtttatggttataatgataggagtagtattcggagagggagaagggacgttaatttcgggcggtgttaggtttcggcggcgatcgaatcgattaagttgtattcggcggggattttcggggtcgtcgttttattttcggtcgtacgggatgttttcgcgagaggatggtggtcggtttcgttagaggggcggggcgcggttgcgcggcgcgcggtcgttatggtgacgtacgtcgttggcgcgaggattttttgtgagtcgttttcggtttcgcggtcgcggaggtgtg

SEQ ID NO: 39936 - DNA, 919 bp, Artificial Sequence
  chemically treated genomic DNA (Homo sapiens) CpG-island No: 39936
cacacctccgcgaccgcgaaaccgaaaacgactcacaaaaaatcctcgcgccaacgacgtacgtcaccataacgaccgcgcgccgcgcaaccgcgccccgcccctctaacgaaaccgaccaccatcctctcgcgaaaacatcccgtacgaccgaaaataaaacgacgaccccgaaaatccccgccgaatacaacttaatcgattcgatcgccgccgaaacctaacaccgcccgaaattaacgtcccttctccctctccgaatactactcctatcattataaccataaacgataaaaaatcgcgaccgtcctccgaaaactcgcgcgcgaaacgaaaccgcttctcccactaacgtaaactccgcccacctaaaaccgcgaacaaaactcaaaaaaactcgaacctcgaccgtcgatcccccgaaaccccatccccaaaacctcgaccaccgacctaaaaccccttttcccgatcgtcgtcccccgatccccgacccgaaccccatccccaaaacctcgaccaccgacctaaaaccccttttcccgaacctcgtcccccgatacccgacccgaaaccccttccccaaaacctaaaccaccaacccgaaaccccttttcccgaacctcgaccctcgatccccgacccgaaaccccttccccaaaacctctaccaccgacccgaaaccccttctcccgaacctcgacccccgaccaccgaccgaaacccttcccaaacccccgacccccaacccgaaatcctttaccccgaacctcgaccctcgacccgaaacccctccccccaaacctcgatccccgacccccgattcgaaaccccttccccgaaacctccatccccaaatctcaacccgatataccttccccgaaacctcgacctctaacccccaaccataaacccgaaa

SEQ ID NO: 39937 - DNA, 1131 bp, Artificial Sequence
  chemically treated genomic DNA (Homo sapiens) CpG-island No: 39937
ggatgttttatgtgatgggtgattagatatttcgtgttagcgggagacggaatgtttcgtgtgacgggtgacgggatgttttatgtgatgggtgagatgttttgtgtgattggtgagatgttttatgtgacgggtgatgggatgtttcgtgtgataggtgacgggatgttttatgtgatgggttacgggatgtttcgtgtgacgggtgacgggatgtttcgtgtgataggtgatgggatgtttcgtgtgacgggtgagatgttttatgttagcgggtgacgggatgtttcgtgtgatgggtgagatgttttatgtgacgggtgatgggatgtttcgtgtgacgggtgatggtatgtttcgtgtgacgggtgatgggatgtttcgtgtgatgggtgatcgggatgtttcgtgttatttacggtgacggtatgtttcgtgtgacgggtgagatgttttgtgttagcggtgatgggatgttttcgtgtgatgggtgagatgttttgtgttagcgggtgacgggatgtttcgtgtgatatggtgagatgtttcgtgtgatgggtgatgggatgttttatgtgacgggtgatgggatgtttcgtgtgacgggtgagatgtttcgtgttagtaggtgacgggatgtttcgtgtgatgggtgagatgtttcgtgtgatgggtgatgggatgttttatgtgacgggtgatgggatgtttcgtgtgacgggtgagatgttttgtgttagcgggtgttcgggatgtttcgtgtgatgggtgagatgtttcgtgtgatgggtgagatgtttcgtgtgatgggtgatgggatgtttcgtgtgatgggtgatgggatgttttatgtgacgggtgatgggatgtttcgtgtgacgggtgatgggatgtttcgtgtgacgggtgagatgttttgtgttagcgggtgacgggatgtttcgtgtgatgggtgagatgttttgtgtttgtaggtgatgggatgtttcgtgtgacgggtgagatgtttcgtgttagcgggtgacgggatgtttcgtgtgatgggtgagatgttttgtgtgatgggtgatgggatgtttcgtgtgatgggtgatgggatgttttatgtgagtagatgacgggatgttttat

SEQ ID NO: 39938 - DNA, 1131 bp, Artificial Sequence
  chemically treated genomic DNA (Homo sapiens) CpG-island No: 39938
ataaaacatcccgtcatctactcacataaaacatcccatcacccatcacacgaaacatcccatcacccatcacacaaaacatctcacccatcacacgaaacatcccgtcacccgctaacacgaaacatctcacccgtcacacgaaacatcccatcacctacaaacacaaaacatctcacccatcacacgaaacatcccgtcacccgctaacacaaaacatctcacccgtcacacgaaacatcccatcacccgtcacacgaaacatcccatcacccgtcacataaaacatcccatcacccatcacacgaaacatcccatcacccatcacacgaaacatctcacccatcacacgaaacatctcacccatcacacgaaacatcccgaacacccgctaacacaaaacatctcacccgtcacacgaaacatcccatcacccgtcacataaaacatcccatcacccatcacacgaaacatctcacccatcacacgaaacatcccgtcacctactaacacgaaacatctcacccgtcacacgaaacatcccatcacccgtcacataaaacatcccatcacccatcacacgaaacatctcaccatatcacacgaaacatcccgtcacccgctaacacaaaacatctcacccatcacacgaaaacatcccatcaccgctaacacaaaacatctcacccgtcacacgaaacataccgtcaccgtaaataacacgaaacatcccgatcacccatcacacgaaacatcccatcacccgtcacacgaaacataccatcacccgtcacacgaaacatcccatcacccgtcacataaaacatctcacccatcacacgaaacatcccgtcacccgctaacataaaacatctcacccgtcacacgaaacatcccatcacctatcacacgaaacatcccgtcacccgtcacacgaaacatcccgtaacccatcacataaaacatcccgtcacctatcacacgaaacatcccatcacccgtcacataaaacatctcaccaatcacacaaaacatctcacccatcacataaaacatcccgtcacccgtcacacgaaacattccgtctcccgctaacacgaaatatctaatcacccatcacataaaacatcc

SEQ ID NO: 39939 - DNA, 1131 bp, Artificial Sequence
  chemically treated genomic DNA (Homo sapiens) CpG-island No: 39939
atggaatatttcgttatttgtttatatggaatattttattatttattatacggaatattttattatttattatatagaatattttatttattatacggaatatttcgttattcgttgatacggaatattttattcgttatacggaatattttattatttgtagatatagaatattttatttattatacggaatatttcgttattcgttgatatagaatattttattcgttatacggaatattttattattcgttatacggaatattttattattcgttatatggaatattttattatttattatacggaatattttattatttattatacggaatattttatttattatacggaatattttatttattatacggaatatttcgaatattcgttgatatagaatattttattcgttatacggaatattttattattcgttatatggaatattttattatttattatacggaatattttatttattatacggaatatttcgttatttgttgatacggaatattttattcgttatacggaatattttattattcgttatatggaatattttattatttattatacggaatattttattatgttatacggaatatttcgttattcgttgatatagaatattttatttattatacgggaatattttattatcgttgatatagaatattttattcgttatacggaatatatcgttatcgtgaataatacggaatatttcggttatttattatacggaatattttattattcgttatacggaatatgttattattcgttatacggaatattttattattcgttatatggaatattttatttattatacggaatatttcgttattcgttgatatggaatattttattcgttatacggaatattttattatttgttatacggaatatttcgttattcgttatacggaatatttcgtaatttattatatggaatatttcgttatttgttatacggaatattttattattcgttatatggaatattttattaattatatagaatattttatttattatatggaatatttcgttattcgttatacggaatatttcgtttttcgttgatacggaatatttgattatttattatatggaatattt

SEQ ID NO: 39940 - DNA, 1131 bp, Artificial Sequence
  chemically treated genomic DNA (Homo sapiens) CpG-island No: 39940
aaatattccatataataaataatcaaatattccgtatcaacgaaaaacgaaatattccgtataacgaataacgaaatattccatataataaataaaatattctatataattaataaaatattccatataacgaataataaaatattccgtataacaaataacgaaatattccatataataaattacgaaatattccgtataacgaataacgaaatattccgtataacaaataataaaatattccgtataacgaataaaatattccatatcaacgaataacgaaatattccgtataataaataaaatattccatataacgaataataaaatattccgtataacgaataataacatattccgtataacgaataataaaatattccgtataataaataaccgaaatattccgtattattcacgataacgatatattccgtataacgaataaaatattctatatcaacgataataaaatattcccgtataataaataaaatattctatatcaacgaataacgaaatattccgtataacataataaaatattccgtataataaataataaaatattccatataacgaataataaaatattccgtataacgaataaaatattccgtatcaacaaataacgaaatattccgtataataaataaaatattccgtataataaataataaaatattccatataacgaataataaaatattccgtataacgaataaaatattctatatcaacgaatattcgaaatattccgtataataaataaaatattccgtataataaataaaatattccgtataataaataataaaatattccgtataataaataataaaatattccatataacgaataataaaatattccgtataacgaataataaaatattccgtataacgaataaaatattctatatcaacgaataacgaaatattccgtataataaataaaatattctatatctacaaataataaaatattccgtataacgaataaaatattccgtatcaacgaataacgaaatattccgtataataaataaaatattctatataataaataataaaatattccgtataataaataataaaatattccatataaacaaataacgaaatattccat

SEQ ID NO: 39941 - DNA, 1531 bp, Artificial Sequence
  chemically treated genomic DNA (Homo sapiens) CpG-island No: 39941
gtcgacgcggagatttagcgcggggttagtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgcgacgtggagatttagcgcggggtcggtggagaaaaggtcgcgacgtggagatttagcgcggggtcggtggagaaaaggtcgcgacgtggagatttagcgcggggtcggtggagaaaaggtcgcgacgtggagatttagcgcggggtcggtggagaaaaggtcgtcgacgtggagatttagcgcggggtcggtggagaaaaggtcgcgacgtggagatttagcgcggggtcggtggagaaaaggtcgtcgacggtggagatttagcgcggggtcggtggagaaaaggtcgcgacgtggggatttagcgcggggttagtggagaataggtcgtcgatttggggatttagcgcgggtcgttggagaaaaggtcgtcgacgtggagatttagtcgcggggtcggttggagaaaaggtacgtcgacgtggagatttagcgcggggtcggtggagaaaaggtcgtcgacgtgggagatttagcgcggggtcggtggagaaaaggtcgtcgacgtggggatttagcgcggggtcggtggagaaaaggtcgtcgaacgtggggatttagcgcggggtcggtggagaaaaggtcgtcgacgtggaggatttagcgcggggtcggttggagaaaaggtcgtcgacgtggatatttagcgcggggtcggtggagaaaaggtcgtcgacgtggagatttagcgcggggtcggtggagaaaaggtcgtcgacgtggagatttagcgcggggtcggtggagaaaaggtcgtcgacgtggagatttagcgcggggtcggtggagaaaaggtcgtcgacgtggggatttagcgcggggttcgtggagaaaaggtcgtcgacgtggatatttagcgcggggttcgtggagaaaaggtcgtcgacgtggatatttagcgcggggttcgtggagaaaaggtcgtcgacgtggggtttttaggattgttgtgtttttttggtttatttgtattgtgtgaagga

SEQ ID NO: 39942 - DNA, 1531 bp, Artificial Sequence
  chemically treated genomic DNA (Homo sapiens) CpG-island No: 39942
tccttcacacaatacaaataaaccaaaaaaacacaacaatcctaaaaaccccacgtcgacgaccttttctccacgaaccccgcgctaaatatccacgtcgacgaccttttctccacgaaccccgcgctaaatatccacgtcgacgaccttttctccacgaaccccgcgctaaatccccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatatccacgtcgacgaccttttctccaaccgaccccgcgctaaatcctccacgtcgacgaccttttctccaccgaccccgcgctaaatccccacgttcgacgaccttttctccaccgaccccgcgctaaatccccacgtcgacgaccttttctccaccgaccccgcgctaaatctcccacgtcgacgaccttttctccaccgaccccgcgctaaatctccacgtcgacgtaccttttctccaaccgaccccgcgactaaatctccacgtcgacgaccttttctccaacgacccgcgctaaatccccaaatcgacgacctattctccactaaccccgcgctaaatccccacgtcgcgaccttttctccaccgaccccgcgctaaatctccaccgtcgacgaccttttctccaccgaccccgcgctaaatctccacgtcgcgaccttttctccaccgaccccgcgctaaatctccacgtcgacgaccttttctccaccgaccccgcgctaaatctccacgtcgcgaccttttctccaccgaccccgcgctaaatctccacgtcgcgaccttttctccaccgaccccgcgctaaatctccacgtcgcgaccttttctccaccgaccccgcgctaaatctccacgtcgcgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccaccgaccccgcgctaaatctccacgtcgacgaccttttctccactaaccccgcgctaaatctccgcgtcgac

SEQ ID NO: 39943 - DNA, 1531 bp, Artificial Sequence
  chemically treated genomic DNA (Homo sapiens) CpG-island No: 39943
ttttttatatagtgtaggtgggttaggagggtatagtagttttggagattttacgtcggcggttttttttttacggatttcgcgttgggtgtttacgtcggcggttttttttttacggatttcgcgttgggtgtttacgtcggcggttttttttttacggatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtgtttacgtcggcggttttttttttagtcgatttcgcgttgggttttttacgtcggcggttttttttttatcgatttcgcgttgggtttttacgttcggcggttttttttttatcgatttcgcgttgggtttttacgtcggcggttttttttttatcgatttcgcgttgggttttttacgtcggcggttttttttttatcgatttcgcgttgggtttttacgtcggcgtgttttttttttagtcgatttcgcgattgggtttttacgtcggcggttttttttttagcgattcgcgttgggtttttaagtcggcggtttgttttttattgatttcgcgttgggtttttacgtcgcggttttttttttatcgatttcgcgttgggtttttatcgtcggcggttttttttttatcgatttcgcgttgggtttttacgtcgcggttttttttttatcgatttcgcgttgggtttttacgtcggcggttttttttttatcgatttcgcgttgggtttttacgtcgcggttttttttttatcgatttcgcgttgggtttttacgtcgcggttttttttttatcgatttcgcgttgggtttttacgtcgcggttttttttttatcgatttcgcgttgggtttttacgtcgcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttatcgatttcgcgttgggtttttacgtcggcggttttttttttattgatttcgcgttgggttttcgcgtcggt

SEQ ID NO: 39944 - DNA, 1531 bp, Artificial Sequence
  chemically treated genomic DNA (Homo sapiens) CpG-island No: 39944
accgacgcgaaaacccaacgcgaaatcaataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgcgacgtaaaaacccaacgcgaaatcgataaaaaaaaaaccgcgacgtaaaaacccaacgcgaaatcgataaaaaaaaaaccgcgacgtaaaaacccaacgcgaaatcgataaaaaaaaaaccgcgacgtaaaaacccaacgcgaaatcgataaaaaaaaaaccgccgacgtaaaaacccaacgcgaaatcgataaaaaaaaaaccgcgacgtaaaaacccaacgcgaaatcgataaaaaaaaaaccgccgacgataaaaacccaacgcgaaatcgataaaaaaaaaaccgcgacgtaaaaacccaacgcgaaatcaataaaaaacaaaccgccgacttaaaaacccaacgcgaatcgctaaaaaaaaaaccgccgacgtaaaaacccaatcgcgaaatcgactaaaaaaaaaacacgccgacgtaaaaacccaacgcgaaatcgataaaaaaaaaaccgccgacgtaaaaaacccaacgcgaaatcgataaaaaaaaaaccgccgacgtaaaaacccaacgcgaaatcgataaaaaaaaaaccgccgaacgtaaaaacccaacgcgaaatcgataaaaaaaaaaccgccgacgtaaaaaacccaacgcgaaatcgactaaaaaaaaaaccgccgacgtaaacacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatcgataaaaaaaaaaccgccgacgtaaaaacccaacgcgaaatccgtaaaaaaaaaaccgccgacgtaaacacccaacgcgaaatccgtaaaaaaaaaaccgccgacgtaaacacccaacgcgaaatccgtaaaaaaaaaaccgccgacgtaaaatctccaaaactactataccctcctaacccacctacactatataaaaaa

SEQ ID NO: 39945 - DNA, 531 bp, Artificial Sequence
  chemically treated genomic DNA (Homo sapiens) CpG-island No: 39945
ggtttcgtttttcggtcgcgttttattttttgtagttttcgcgtcgcggtcgttcgagttacgtgcgttcgcgttcggtaggcgtttagggaagcgcggttacgtttgggtcggttattatttttcgggcgtcgcggcggcgtcgattcgcgggtagcggttttttagtgcgtttagtcgggttttcgaacgtcgggagtatgagcgcgggttcggagcgcggggcggcggtaattttcgggggtttgttcgcgttttgcgtttcgaaggtggagttgcggtttagttgtcggtatttgttggatcgcgattcgtttattaagttcgattttagcgtggcgttgttgtagtaggcgtagggttagtgggtgtaggtagggtcggggcgtggaggtcgagaggttatcgggtcggggttggcgtcgagttggggatgcggagattagagcggcgcgttgaggttagtggggcgtaaggcggggtttttcggagttggggtttagttcggggttagggttgggggttattagg

SEQ ID NO: 39946 - DNA, 531 bp, Artificial Sequence
  chemically treated genomic DNA (Homo sapiens) CpG-island No: 39946
cctaataacccccaaccctaaccccgaactaaaccccaactccgaaaaaccccgccttacgccccactaacctcaacgcgccgctctaatctccgcatccccaactcgacgccaaccccgacccgataacctctcgacctccacgccccgaccctacctacacccactaaccctacgcctactacaacaacgccacgctaaaatcgaacttaataaacgaatcgcgatccaacaaataccgacaactaaaccgcaactccaccttcgaaacgcaaaacgcgaacaaacccccgaaaattaccgccgccccgcgctccgaacccgcgctcatactcccgacgttcgaaaacccgactaaacgcactaaaaaaccgctacccgcgaatcgacgccgccgcgacgcccgaaaaataataaccgacccaaacgtaaccgcgcttccctaaacgcctaccgaacgcgaacgcacgtaactcgaacgaccgcgacgcgaaaactacaaaaaataaaacgcgaccgaaaaacgaaacc

SEQ ID NO: 39947 - DNA, 531 bp, Artificial Sequence
  chemically treated genomic DNA (Homo sapiens) CpG-island No: 39947
tttggtaatttttaattttgatttcgagttgagttttagtttcggggggtttcgttttgcgttttattggttttagcgcgtcgttttggttttcgtatttttagttcggcgttagtttcggttcggtggtttttcggtttttacgtttcggttttatttgtatttattggttttgcgtttgttgtagtaacgttacgttggggtcggatttggtgagcgggtcgcggtttagtaggtgtcggtagttgagtcgtagttttattttcgaggcgtagggcgcgggtaaattttcgggggttgtcgtcgtttcgcgtttcgagttcgcgtttatgttttcggcgttcgggggttcggttgggcgtattgaggggtcgttgttcgcgagtcggcgtcgtcgcggcgttcgggaaatggtggtcggtttaggcgtggtcgcgtttttttgaacgtttgtcgggcgcgggcgtacgtggttcgggcggtcgcggcgcggggattgtagggggtggggcgcggtcggggggcggggtt

SEQ ID NO: 39948 - DNA, 531 bp, Artificial Sequence
  chemically treated genomic DNA (Homo sapiens) CpG-island No: 39948
aaccccgccccccgaccgcgccccaccccctacaatccccgcgccgcgaccgcccgaaccacgtacgcccgcgcccgacaaacgttcaaaaaaacgcgaccacgcctaaaccgaccaccatttcccgaacgccgcgacgacgccgactcgcgaacaacgacccctcaatacgcccaaccgaacccccgaacgccgaaaacataaacgcgaactcgaaacgcgaaacgacgacaacccccgaaaatttacccgcgccctacgcctcgaaaataaaactacgactcaactaccgacacctactaaaccgcgacccgctcaccaaatccgaccccaacgtaacgttactacaacaaacgcaaaaccaataaatacaaataaaaccgaaacgtaaaaaccgaaaaaccaccgaaccgaaactaacgccgaactaaaaatacgaaaaccaaaacgacgcgctaaaaccaataaaacgcaaaacgaaaccccccgaaactaaaactcaactcgaaatcaaaattaaaaattaccaaa

SEQ ID NO: 39949 - DNA, 554 bp, Artificial Sequence
  chemically treated genomic DNA (Homo sapiens) CpG-island No: 39949
agggagttcggttggtgtggtggaataaatatttcgttgtcgaggcggggcgtttcgtttaaattaaaagcggtggacggtaatacgttcggcgagtttttattttttagtaggaaatgtgagaggtggttagcgtggagtgtgggattaagaagggcgttacgacgttggggtgtgtggtgagaagggttcgttaaacgttcgagattcgtcgttgttttttcgattttagagtgtaatttgtcgggtttgttgtcgtacggagtcggtgtggcgcgcggggaaatgggagcgaagggttcggttgggggggcgcgtttgcgcggttcggggaatacgtgtcggggcgtgcgtggatatataattaagttacggggggttcgggatgtgttatttgtatttaaacggtttagaaaaaaagggtgtttgcgtggtggggtaggggggaggggcggttcgcggcgtagcgatatattttttttttttttgtatatttggattagtttagtaacgttatatatttatgtagttttatcgcggagtttttatttaag

SEQ ID NO: 39950 - DNA, 554 bp, Artificial Sequence
  chemically treated genomic DNA (Homo sapiens) CpG-island No: 39950
cttaaataaaaactccgcgataaaactacataaatatataacgttactaaactaatccaaatatacaaaaaaaaaaaaaatatatcgctacgccgcgaaccgcccctcccccctaccccaccacgcaaacaccctttttttctaaaccgtttaaatacaaataacacatcccgaaccccccgtaacttaattatatatccacgcacgccccgacacgtattccccgaaccgcgcaaacgcgcccccccaaccgaacccttcgctcccatttccccgcgcgccacaccgactccgtacgacaacaaacccgacaaattacactctaaaatcgaaaaaacaacgacgaatctcgaacgtttaacgaacccttctcaccacacaccccaacgtcgtaacgcccttcttaatcccacactccacgctaaccacctctcacatttcctactaaaaaataaaaactcgccgaacgtattaccgtccaccgcttttaatttaaacgaaacgccccgcctcgacaacgaaatatttattccaccacaccaaccgaactccct

SEQ ID NO: 39951 - DNA, 554 bp, Artificial Sequence
  chemically treated genomic DNA (Homo sapiens) CpG-island No: 39951
tttaagtgaaggtttcgcgatggaattgtataaatgtgtggcgttgttgagttggtttagatgtataaagaggggaaaggtgtgtcgttgcgtcgcgggtcgttttttttttttattttattacgtaaatattttttttttttggatcgtttgagtatagataatatatttcgggtttttcgtaatttagttatatatttacgtacgtttcgatacgtgtttttcgggtcgcgtaagcgcgtttttttaatcgggtttttcgtttttattttttcgcgcgttatatcgatttcgtacgataataggttcggtagattatattttagagtcggaggggtagcggcgagtttcgagcgtttggcgaattttttttattatatattttagcgtcgtgacgttttttttgattttatattttacgttgattattttttatattttttgttaagaagtgaaggttcgtcgagcgtgttgtcgtttatcgtttttggtttgggcggagcgtttcgtttcggtagcggggtatttattttattatattagtcggatttttt

SEQ ID NO: 39952 - DNA, 554 bp, Artificial Sequence
  chemically treated genomic DNA (Homo sapiens) CpG-island No: 39952
aaaaaatccgactaatataataaaataaataccccgctaccgaaacgaaacgctccgcccaaaccaaaaacgataaacgacaacacgctcgacgaaccttcacttcttaacaaaaaatataaaaaataatcaacgtaaaatataaaatcaaaaaaaacgtcacgacgctaaaatatataataaaaaaaattcgccaaacgctcgaaactcgccgctacccctccgactctaaaatataatctaccgaacctattatcgtacgaaatcgatataacgcgcgaaaaaataaaaacgaaaaacccgattaaaaaaacgcgcttacgcgacccgaaaaacacgtatcgaaacgtacgtaaatatataactaaattacgaaaaacccgaaatatattatctatactcaaacgatccaaaaaaaaaaaatatttacgtaataaaataaaaaaaaaaaacgacccgcgacgcaacgacacacctttcccctctttatacatctaaaccaactcaacaacgccacacatttatacaattccatcgcgaaaccttcacttaaa

SEQ ID NO: 39953 - DNA, 651 bp, Artificial Sequence
  chemically treated genomic DNA (Homo sapiens) CpG-island No: 39953
  misc_feature (50)..(50): n is either a, c, g or t
aatttcgacggggcgtggttttcgggtagtagtcggttcgttggtttttncgggaggaaggcgagttaaagttcggcggttattcggattgttacgcgtatttaatttcgcggagtgcggggcgttggggtgtagaggggttttcgttcggcgttatttaggtttttaggcgggaagcggtttaattgggaaagtagtcggcgttcgtggttttcgggtcggtcgttcgcgttttttcggttagtttttcgcggaggggaggggcgtcgacgtcgcgttttcggggtttcgtagtcggcggaagggtcgcgtatcgcggaagcgcggcggtagttgaggattagttgttggaggaggcggagaggtagagggaggagtttcggggggaaggagagggaggggatcgttaggaagtcgcgaacgtcgtcgagtgtttgtatatttcgttttgtttgttatggttggttaaagaattattcggatcgtagcgcggggggagggtcgggtggggggagtagcggtcgcgcgtgaggtcgagggaggggcggcggcgcgagcggcggcggcggcggttttagtatgaagaggagagttggtttggggggtagtatgaggttagtggtgggttttttgttttagcggggtttgtat

SEQ ID NO: 39954 - DNA, 651 bp, Artificial Sequence
  chemically treated genomic DNA (Homo sapiens) CpG-island No: 39954
  misc_feature (602)..(602): n is either a, c, g or t
atacaaaccccgctaaaacaaaaaacccaccactaacctcatactaccccccaaaccaactctcctcttcatactaaaaccgccgccgccgccgctcgcgccgccgcccctccctcgacctcacgcgcgaccgctactccccccacccgaccctccccccgcgctacgatccgaataattctttaaccaaccataacaaacaaaacgaaatatacaaacactcgacgacgttcgcgacttcctaacgatcccctccctctccttccccccgaaactcctccctctacctctccgcctcctccaacaactaatcctcaactaccgccgcgcttccgcgatacgcgacccttccgccgactacgaaaccccgaaaacgcgacgtcgacgcccctcccctccgcgaaaaactaaccgaaaaaacgcgaacgaccgacccgaaaaccacgaacgccgactactttcccaattaaaccgcttcccgcctaaaaacctaaataacgccgaacgaaaacccctctacaccccaacgccccgcactccgcgaaattaaatacgcgtaacaatccgaataaccgccgaactttaactcgccttcctcccgnaaaaaccaacgaaccgactactacccgaaaaccacgccccgtcgaaatt

SEQ ID NO: 39955 - DNA, 651 bp, Artificial Sequence
  chemically treated genomic DNA (Homo sapiens) CpG-island No: 39955
  misc_feature (602)..(602): n is either a, c, g or t
atgtaagtttcgttgggataagaagtttattattgattttatgttgttttttaggttagtttttttttttatgttggaatcgtcgtcgtcgtcgttcgcgtcgtcgtttttttttcggttttacgcgcggtcgttgttttttttattcggtttttttttcgcgttgcgattcggatggttttttaattagttatggtaggtagagcgaggtgtgtagatattcggcggcgttcgcggttttttgacggtttttttttttttttttttttcgaggtttttttttttgttttttcgttttttttagtagttgatttttagttgtcgtcgcgttttcgcgatgcgcggttttttcgtcggttgcggggtttcgagaacgcggcgtcggcgtttttttttttcgcggggggttggtcggaagaacgcgggcggtcggttcggagattacgggcgtcggttgtttttttagttgagtcgtttttcgtttggggatttgggtggcgtcgggcggagatttttttgtattttagcgtttcgtatttcgcggagttgaatgcgcgtaataattcgagtggtcgtcgggttttggttcgtttttttttcgnagggattagcgggtcggttgttgttcggaggttacgtttcgtcgaggtt

SEQ ID NO: 39956 - DNA, 651 bp, Artificial Sequence
  chemically treated genomic DNA (Homo sapiens) CpG-island No: 39956
  misc_feature (50)..(50): n is either a, c, g or t
aacctcgacgaaacgtaacctccgaacaacaaccgacccgctaatccctncgaaaaaaaaacgaaccaaaacccgacgaccactcgaattattacgcgcattcaactccgcgaaatacgaaacgctaaaatacaaaaaaatctccgcccgacgccacccaaatccccaaacgaaaaacgactcaactaaaaaaacaaccgacgcccgtaatctccgaaccgaccgcccgcgttcttccgaccaaccccccgcgaaaaaaaaaaacgccgacgccgcgttctcgaaaccccgcaaccgacgaaaaaaccgcgcatcgcgaaaacgcgacgacaactaaaaatcaactactaaaaaaaacgaaaaaacaaaaaaaaaaacctcgaaaaaaaaaaaaaaaaaaaaaccgtcaaaaaaccgcgaacgccgccgaatatctacacacctcgctctacctaccataactaattaaaaaaccatccgaatcgcaacgcgaaaaaaaaaccgaataaaaaaaacaacgaccgcgcgtaaaaccgaaaaaaaaacgacgacgcgaacgacgacgacgacgattccaacataaaaaaaaaaactaacctaaaaaacaacataaaatcaataataaacttcttatcccaacgaaacttacat

SEQ ID NO: 39957 - DNA, 614 bp, Artificial Sequence
  chemically treated genomic DNA (Homo sapiens) CpG-island No: 39957
  misc_feature (439)..(439): n is either a, c, g or t
ttttttgtcgtagtaaaaaaaagagtattagtcgtttttttgtatcgttttttattgttcgcgtgcggtacgttaattcgggtgttcgatcgacgttttttcgttttatttttacgtttttttcgtttttttcgttttttttgtcgtttcgttttcggtgtacggtcgagtcgttgcgtttttttatgattcgttttgttttcggtcgtatcgagtatgtgtttttttagttcgttttttcgttcgacgtatattattttattatttttttcggttcgtcgttttagtatttagtcgggtcgttttcgtaagttggagtagagtcgcgggtttcgggtgttggtttaataaatttttagatgatatcgggcgtcgagtgtttcgtttttcgtttgtttcgtcgttcgaaatagacgagtgtttagttggggcgttcgtnaggtcgttgtacgttcgcggatgtttcgttcgttattatggtagcgagggaggatagtcgattcgttcggaggtttacgttataaaataagacgcgttagtatggttagtttaaacgtttcgaggggtcgggagcggaagtagtgtggagtaaaatgtagggaagtttgagttgt

SEQ ID NO: 39958 - DNA, 614 bp, Artificial Sequence
  chemically treated genomic DNA (Homo sapiens) CpG-island No: 39958
  misc_feature (176)..(176): n is either a, c, g or t
acaactcaaacttccctacattttactccacactacttccgctcccgacccctcgaaacgtttaaactaaccatactaacgcgtcttattttataacgtaaacctccgaacgaatcgactatcctccctcgctaccataataacgaacgaaacatccgcgaacgtacaacgacctnacgaacgccccaactaaacactcgtctatttcgaacgacgaaacaaacgaaaaacgaaacactcgacgcccgatatcatctaaaaatttattaaaccaacacccgaaacccgcgactctactccaacttacgaaaacgacccgactaaatactaaaacgacgaaccgaaaaaaataataaaataatatacgtcgaacgaaaaaacgaactaaaaaaacacatactcgatacgaccgaaaacaaaacgaatcataaaaaaacgcaacgactcgaccgtacaccgaaaacgaaacgacaaaaaaaacgaaaaaaacgaaaaaaacgtaaaaataaaacgaaaaaacgtcgatcgaacacccgaattaacgtaccgcacgcgaacaataaaaaacgatacaaaaaaacgactaatactcttttttttactacgacaaaaaa

SEQ ID NO: 39959 - DNA, 614 bp, Artificial Sequence
  chemically treated genomic DNA (Homo sapiens) CpG-island No: 39959
  misc_feature (176)..(176): n is either a, c, g or t
gtaatttaagtttttttgtattttgttttatattgttttcgttttcggtttttcggagcgtttagattaattatattggcgcgttttattttgtaacgtgaattttcgagcgaatcggttattttttttcgttattataatggcgggcgggatattcgcggacgtatagcgatttngcgggcgttttaattggatattcgtttatttcgggcgacggaatagacgaaaggcggggtattcggcgttcggtgttatttgggggtttgttgggttaatattcggggttcgcggttttgttttagtttacgggggcgattcggttaagtgttagggcggcgggtcggggggggtaatgagatggtatgcgtcgggcgggaaggcgggttaaaggggtatatgttcggtacggtcggggataaaacgaattatggggaagcgtaacggttcggtcgtatatcggaaacggaacggtaggaaaggcgggggaaacggggaaagcgtgggggtggggcgggaggacgtcggtcgggtattcgggttggcgtatcgtacgcgggtaatggggggcggtgtaagggggcgattggtgtttttttttttgttgcgatagaggg

SEQ ID NO: 39960 - DNA, 614 bp, Artificial Sequence
  chemically treated genomic DNA (Homo sapiens) CpG-island No: 39960
  misc_feature (439)..(439): n is either a, c, g or t
ccctctatcgcaacaaaaaaaaaaacaccaatcgcccccttacaccgccccccattacccgcgtacgatacgccaacccgaatacccgaccgacgtcctcccgccccacccccacgctttccccgtttcccccgcctttcctaccgttccgtttccgatatacgaccgaaccgttacgcttccccataattcgttttatccccgaccgtaccgaacatatacccctttaacccgccttcccgcccgacgcataccatctcattaccccccccgacccgccgccctaacacttaaccgaatcgcccccgtaaactaaaacaaaaccgcgaaccccgaatattaacccaacaaacccccaaataacaccgaacgccgaataccccgcctttcgtctattccgtcgcccgaaataaacgaatatccaattaaaacgcccgcnaaatcgctatacgtccgcgaatatcccgcccgccattataataacgaaaaaaaataaccgattcgctcgaaaattcacgttacaaaataaaacgcgccaatataattaatctaaacgctccgaaaaaccgaaaacgaaaacaatataaaacaaaatacaaaaaaacttaaattac

SEQ ID NO: 39961 - DNA, 556 bp, Artificial Sequence
  chemically treated genomic DNA (Homo sapiens) CpG-island No: 39961
tgcgtcggcggaacgttcgttttttcgttcgtttcggtttttcggggacggtcgtagcgggtcgggtgtcgcgatcgtggtaaataaaggttcgtaggggacgggggcgggggtaacggttaggtgatagtgtcgagtgtatttcgtaatcgttttaatggggttttacgggttcgcggttttggggattttattttgatttcgttatttttttcggatagaatcgacggtcgttttattaaataagaaggttggatttgaggcggtcgtattttttcgggttttttgaaataaaaagtagcgtttcgttcgtagtttatcggtaataagtagtattcgtttgtttagtcgtttttttcggcggcgttcggtttcgcggcgattaagtttatcgtatttgcggttatttttagtttcggtaattatttcgttttagttaggtcgtattagtcgcgtcgcggtttcgggtcgtagtgttaggaggcgcgcgcgtttttttttagggttgtagttattaagcgggggaggaagattttttaggtgaattttggaggtt

SEQ ID NO: 39962 - DNA, 556 bp, Artificial Sequence
  chemically treated genomic DNA (Homo sapiens) CpG-island No: 39962
aacctccaaaattcacctaaaaaatcttcctcccccgcttaataactacaaccctaaaaaaaaacgcgcgcgcctcctaacactacgacccgaaaccgcgacgcgactaatacgacctaactaaaacgaaataattaccgaaactaaaaataaccgcaaatacgataaacttaatcgccgcgaaaccgaacgccgccgaaaaaaacgactaaacaaacgaatactacttattaccgataaactacgaacgaaacgctactttttatttcaaaaaacccgaaaaaatacgaccgcctcaaatccaaccttcttatttaataaaacgaccgtcgattctatccgaaaaaaataacgaaatcaaaataaaatccccaaaaccgcgaacccgtaaaaccccattaaaacgattacgaaatacactcgacactatcacctaaccgttacccccgcccccgtcccctacgaacctttatttaccacgatcgcgacacccgacccgctacgaccgtccccgaaaaaccgaaacgaacgaaaaaacgaacgttccgccgacgca

SEQ ID NO: 39963 - DNA, 556 bp, Artificial Sequence
  chemically treated genomic DNA (Homo sapiens) CpG-island No: 39963
ggtttttagggtttatttggggggtttttttttttcgtttggtagttatagttttgagggagggcgcgcgcgttttttggtattacggttcggaatcgcggcgcggttggtgcggtttggttagggcggggtggttgtcgggattgggggtagtcgtaggtgcggtaggtttagtcgtcgcggggtcgggcgtcgtcgggggaggcggttgggtagacgggtgttgtttgttgtcgatgggttgcgaacggggcgttgttttttattttaggaagttcgggggagtgcgatcgttttaaatttagtttttttgtttggtgggacgatcgtcggttttgttcgggaggaatgacggggttaaggtggggtttttagggtcgcgggttcgtgaagttttattaaagcgattgcgaaatgtattcggtattgttatttgatcgttattttcgttttcgttttttgcgagtttttgtttattacgatcgcgatattcggttcgttgcggtcgttttcggggagtcggggcgggcgggggagcgggcgtttcgtcggcgta

SEQ ID NO: 39964 - DNA, 556 bp, Artificial Sequence
  chemically treated genomic DNA (Homo sapiens) CpG-island No: 39964
tacgccgacgaaacgcccgctcccccgcccgccccgactccccgaaaacgaccgcaacgaaccgaatatcgcgatcgtaataaacaaaaactcgcaaaaaacgaaaacgaaaataacgatcaaataacaataccgaatacatttcgcaatcgctttaataaaacttcacgaacccgcgaccctaaaaaccccaccttaaccccgtcattcctcccgaacaaaaccgacgatcgtcccaccaaacaaaaaaactaaatttaaaacgatcgcactcccccgaacttcctaaaataaaaaacaacgccccgttcgcaacccatcgacaacaaacaacacccgtctacccaaccgcctcccccgacgacgcccgaccccgcgacgactaaacctaccgcacctacgactacccccaatcccgacaaccaccccgccctaaccaaaccgcaccaaccgcgccgcgattccgaaccgtaataccaaaaaacgcgcgcgccctccctcaaaactataactaccaaacgaaaaaaaaaaaccccccaaataaaccctaaaaacc

SEQ ID NO: 39965 - DNA, 773 bp, Artificial Sequence
  chemically treated genomic DNA (Homo sapiens) CpG-island No: 39965
  misc_feature (92)..(92): n is either a, c, g or t
  misc_feature (116)..(116): n is either a, c, g or t
tcgttcgtagatcgtttatttatagtagtgagcgaatttaaattttatacggttaagtttcgcgggttttaggaaatttcgaagaggtcggnggttaggggcgattatggcgcggnggaggttggggattgtagtttttatttgttttcggggcggtgttcgagggcggggtttttaggtcgagggggtgggtgggtcgtttagcgtttcggttcgtttcggcgttttcggtcgtaggcgggttttggaggaggaggggcgtcgcgatcgacgcgcgcgagttggtttgggatttttggcggtgcgagcgggtgcgcgcgtagcgggtcggttgtggcggcggagatggaggagggaggtcgggataaggcgtcggtgtagttttagtagtttttagcggcggttttcggcggtacggacgagaagtcgagcggtaaggagcggcgggatgtcggggataaggataaagaataggagttggtgaggcgcgatttcgagagtcggcgaaggaggttgcggggttgagttacggcggtttcgtaggttttaggttcgatatttaattattttatcgcgttagggagaggcgcggttggggcgattttcgggattttcggtattttgtttttttgttttttatttttcgtttcgcgttgttattttcgtcgtttttattaatttttattatcgtcgcgtgaagtggattcgggtaggttattgttattttcgttttttagagtggtatttaagtagaatttgatttagaatttagg

SEQ ID NO: 39966 - DNA, 773 bp, Artificial Sequence
  chemically treated genomic DNA (Homo sapiens) CpG-island No: 39966
  misc_feature (658)..(658): n is either a, c, g or t
  misc_feature (682)..(682): n is either a, c, g or t
cctaaattctaaatcaaattctacttaaataccactctaaaaaacgaaaataacaataacctacccgaatccacttcacgcgacgataataaaaattaataaaaacgacgaaaataacaacgcgaaacgaaaaataaaaaacaaaaaaacaaaataccgaaaatcccgaaaatcgccccaaccgcgcctctccctaacgcgataaaataattaaatatcgaacctaaaacctacgaaaccgccgtaactcaaccccgcaacctccttcgccgactctcgaaatcgcgcctcaccaactcctattctttatccttatccccgacatcccgccgctccttaccgctcgacttctcgtccgtaccgccgaaaaccgccgctaaaaactactaaaactacaccgacgccttatcccgacctccctcctccatctccgccgccacaaccgacccgctacgcgcgcacccgctcgcaccgccaaaaatcccaaaccaactcgcgcgcgtcgatcgcgacgcccctcctcctccaaaacccgcctacgaccgaaaacgccgaaacgaaccgaaacgctaaacgacccacccaccccctcgacctaaaaaccccgccctcgaacaccgccccgaaaacaaataaaaactacaatccccaacctccnccgcgccataatcgcccctaaccnccgacctcttcgaaatttcctaaaacccgcgaaacttaaccgtataaaatttaaattcgctcactactataaataaacgatctacgaacga

SEQ ID NO: 39967 - DNA, 773 bp, Artificial Sequence
  chemically treated genomic DNA (Homo sapiens) CpG-island No: 39967
  misc_feature (658)..(658): n is either a, c, g or t
  misc_feature (682)..(682): n is either a, c, g or t
tttgggttttgaattaggttttatttgaatgttattttaggaaacggaggtgataatgatttgttcgagtttattttacgcggcggtggtgagggttggtggggacggcggaggtgatagcgcggaacggagaatgaggagtagagaggtaaggtgtcgggagtttcgagggtcgttttaatcgcgtttttttttggcgcggtggggtagttgggtgtcgggtttgaggtttgcggagtcgtcgtgatttagtttcgtagtttttttcgtcgattttcggggtcgcgttttattagtttttgttttttgtttttgttttcggtatttcgtcgttttttgtcgttcggtttttcgttcgtgtcgtcgggggtcgtcgttggagattgttggggttgtatcggcgttttgtttcggttttttttttttattttcgtcgttatagtcggttcgttgcgcgcgtattcgttcgtatcgttaaaaattttagattaattcgcgcgcgtcggtcgcggcgtttttttttttttagagttcgtttgcgatcggaaacgtcggggcgagtcggggcgttaggcgatttatttattttttcggtttgagagtttcgttttcggatatcgtttcggaggtaggtggagattataatttttagtttttntcgcgttatagtcgtttttggttntcgattttttcggagttttttgaaattcgcgggatttggtcgtgtggggtttgggttcgtttattgttgtagatgggcggtttgcgagcgg

SEQ ID NO: 39968 - DNA, 773 bp, Artificial Sequence
  chemically treated genomic DNA (Homo sapiens) CpG-island No: 39968
  misc_feature (92)..(92): n is either a, c, g or t
  misc_feature (116)..(116): n is either a, c, g or t
ccgctcgcaaaccgcccatctacaacaataaacgaacccaaaccccacacgaccaaatcccgcgaatttcaaaaaactccgaaaaaatcganaaccaaaaacgactataacgcganaaaaactaaaaattataatctccacctacctccgaaacgatatccgaaaacgaaactctcaaaccgaaaaaataaataaatcgcctaacgccccgactcgccccgacgtttccgatcgcaaacgaactctaaaaaaaaaaaaacgccgcgaccgacgcgcgcgaattaatctaaaatttttaacgatacgaacgaatacgcgcgcaacgaaccgactataacgacgaaaataaaaaaaaaaaaccgaaacaaaacgccgatacaaccccaacaatctccaacgacgacccccgacgacacgaacgaaaaaccgaacgacaaaaaacgacgaaataccgaaaacaaaaacaaaaaacaaaaactaataaaacgcgaccccgaaaatcgacgaaaaaaactacgaaactaaatcacgacgactccgcaaacctcaaacccgacacccaactaccccaccgcgccaaaaaaaaacgcgattaaaacgaccctcgaaactcccgacaccttacctctctactcctcattctccgttccgcgctatcacctccgccgtccccaccaaccctcaccaccgccgcgtaaaataaactcgaacaaatcattatcacctccgtttcctaaaataacattcaaataaaacctaattcaaaacccaaa

SEQ ID NO: 39969 - DNA, 504 bp, Artificial Sequence
  chemically treated genomic DNA (Homo sapiens) CpG-island No: 39969
atgtcggaggcgggtttttcggcggcgttcgatcgttttttttcgtcgtagttcggcgtttgtttttcgattaggtttgagacgttttttatcgtttatattttcgttcgggtgggtttttcgtgcgttcggtttttgagggggtcggcgtttttatgtcgtattcgcgtatgtgggtttaacgcgattttcgatattttcgtttacgtttttacgtttcgtcgtcgtaattttatttcggaaaacgtatcgggcgggcgtgggggtatttttttttttgttttacgtcgtcgttttagttttatttttaaaagtcgttcgttttgttttatttttcgcggttttcgtttcgggtagttatcgttgtgcgtttttcgcgtggtttttttttcggttttcgggcgcgtaatcgtacggtgaatatttattcgttttaaaaacgggcgcgcgtatcgtaatcgggtcggcgttcgtatgcgcgttcgaagttgttttttttttaag

SEQ ID NO: 39970 - DNA, 504 bp, Artificial Sequence
  chemically treated genomic DNA (Homo sapiens) CpG-island No: 39970
cttaaaaaaaaaacaacttcgaacgcgcatacgaacgccgacccgattacgatacgcgcgcccgtttttaaaacgaataaatattcaccgtacgattacgcgcccgaaaaccgaaaaaaaaaccacgcgaaaaacgcacaacgataactacccgaaacgaaaaccgcgaaaaataaaacaaaacgaacgacttttaaaaataaaactaaaacgacgacgtaaaacaaaaaaaaaaatacccccacgcccgcccgatacgttttccgaaataaaattacgacgacgaaacgtaaaaacgtaaacgaaaatatcgaaaatcgcgttaaacccacatacgcgaatacgacataaaaacgccgaccccctcaaaaaccgaacgcacgaaaaacccacccgaacgaaaatataaacgataaaaaacgtctcaaacctaatcgaaaaacaaacgccgaactacgacgaaaaaaaacgatcgaacgccgccgaaaaacccgcctccgacat

SEQ ID NO: 39971 - DNA, 504 bp, Artificial Sequence
  chemically treated genomic DNA (Homo sapiens) CpG-island No: 39971
tttggggggggaatagtttcgggcgcgtatgcgggcgtcgattcggttgcggtgcgcgcgttcgtttttggggcgggtgagtgtttatcgtgcgattgcgcgttcgaaaatcgggaaagaggttacgcggggggcgtatagcggtggttgttcggagcgagagtcgcggggggtggggtaaaacgggcggtttttggggatggggttgggacggcggcgtggagtagggagaaaaatatttttacgttcgttcgatgcgtttttcggggtggggttgcggcgacggggcgtaggggcgtgggcggagatgtcgggggtcgcgttgggtttatatgcgcgggtgcggtatgggggcgtcggtttttttagaggtcggacgtacggggggtttattcgggcggagatatgggcgataaagggcgttttaggtttaatcggggggtaggcgtcgagttgcggcggggggggacggtcgagcgtcgtcgggaggttcgttttcggtat

SEQ ID NO: 39972 - DNA, 504 bp, Artificial Sequence
  chemically treated genomic DNA (Homo sapiens) CpG-island No: 39972
ataccgaaaacgaacctcccgacgacgctcgaccgtccccccccgccgcaactcgacgcctaccccccgattaaacctaaaacgccctttatcgcccatatctccgcccgaataaaccccccgtacgtccgacctctaaaaaaaccgacgcccccataccgcacccgcgcatataaacccaacgcgacccccgacatctccgcccacgcccctacgccccgtcgccgcaaccccaccccgaaaaacgcatcgaacgaacgtaaaaatatttttctccctactccacgccgccgtcccaaccccatccccaaaaaccgcccgttttaccccaccccccgcgactctcgctccgaacaaccaccgctatacgccccccgcgtaacctctttcccgattttcgaacgcgcaatcgcacgataaacactcacccgccccaaaaacgaacgcgcgcaccgcaaccgaatcgacgcccgcatacgcgcccgaaactattccccccccaaa

SEQ ID NO: 39973 - DNA, 585 bp, Artificial Sequence
  chemically treated genomic DNA (Homo sapiens) CpG-island No: 39973
tttttcgaggtagtcgcgcgttcgtgggttagtgcggttggtggtattcggtagggaggcgcgtcggttacgtagcgattcgcgggcgacgttttcggaacgttttcgaggtacggtcgcgttttagcgtataacgtcgaagcgcgggacgtcgtagtaattgacggaagaggagatcgattaatatagtcgtcgacgggtatttagagtcgacgatacggcgcggtcgggttgttatagatacgcgtcggttattttcgtatcgtcggcgcgcggattatcgtacgtttcgacgacgatcgtataattcggtcggcgtcgcgtatttcgacgtatttcgggatacggcgagcgtagagcgttatttgtttttttagaatcgtcgtataacgtagtttcggcgcgttatacgcgttttcgaatcgtttatttcggtatcgtttcgttcggacgtacggtttcgttttatacgtcgaggtcggttgtgtcgtagaggtgacgcgcgagcgacggtttgcgttagaacgagcgcgacgagcggcggcgtgacgtcgtacgcgagcgcgcgcgagtcgtcgcgatcgt

SEQ ID NO: 39974 - DNA, 585 bp, Artificial Sequence
  chemically treated genomic DNA (Homo sapiens) CpG-island No: 39974
acgatcgcgacgactcgcgcgcgctcgcgtacgacgtcacgccgccgctcgtcgcgctcgttctaacgcaaaccgtcgctcgcgcgtcacctctacgacacaaccgacctcgacgtataaaacgaaaccgtacgtccgaacgaaacgataccgaaataaacgattcgaaaacgcgtataacgcgccgaaactacgttatacgacgattctaaaaaaacaaataacgctctacgctcgccgtatcccgaaatacgtcgaaatacgcgacgccgaccgaattatacgatcgtcgtcgaaacgtacgataatccgcgcgccgacgatacgaaaataaccgacgcgtatctataacaacccgaccgcgccgtatcgtcgactctaaatacccgtcgacgactatattaatcgatctcctcttccgtcaattactacgacgtcccgcgcttcgacgttatacgctaaaacgcgaccgtacctcgaaaacgttccgaaaacgtcgcccgcgaatcgctacgtaaccgacgcgcctccctaccgaataccaccaaccgcactaacccacgaacgcgcgactacctcgaaaaa

SEQ ID NO: 39975 - DNA, 585 bp, Artificial Sequence
  chemically treated genomic DNA (Homo sapiens) CpG-island No: 39975
gcggtcgcggcggttcgcgcgcgttcgcgtgcggcgttacgtcgtcgttcgtcgcgttcgttttggcgtaggtcgtcgttcgcgcgttatttttacggtatagtcggtttcggcgtgtggggcggagtcgtgcgttcgggcggggcggtgtcggggtgggcggttcggaggcgcgtgtggcgcgtcggggttgcgttgtgcggcggttttggagggataggtggcgttttgcgttcgtcgtgtttcggggtgcgtcggggtgcgcggcgtcggtcgggttgtgcggtcgtcgtcgaggcgtgcggtggttcgcgcgtcggcggtgcggaggtggtcggcgcgtgtttgtggtaattcggtcgcgtcgtgtcgtcggttttgggtgttcgtcggcggttgtgttggtcggttttttttttcgttagttgttgcggcgtttcgcgtttcggcgttgtgcgttggggcgcggtcgtgtttcgggggcgtttcgggggcgtcgttcgcgggtcgttgcgtggtcgacgcgtttttttgtcgggtgttattaatcgtattagtttacgggcgcgcggttgtttcgagggg

SEQ ID NO: 39976 - DNA, 585 bp, Artificial Sequence
  chemically treated genomic DNA (Homo sapiens) CpG-island No: 39976
cccctcgaaacaaccgcgcgcccgtaaactaatacgattaataacacccgacaaaaaaacgcgtcgaccacgcaacgacccgcgaacgacgcccccgaaacgcccccgaaacacgaccgcgccccaacgcacaacgccgaaacgcgaaacgccgcaacaactaacgaaaaaaaaaaccgaccaacacaaccgccgacgaacacccaaaaccgacgacacgacgcgaccgaattaccacaaacacgcgccgaccacctccgcaccgccgacgcgcgaaccaccgcacgcctcgacgacgaccgcacaacccgaccgacgccgcgcaccccgacgcaccccgaaacacgacgaacgcaaaacgccacctatccctccaaaaccgccgcacaacgcaaccccgacgcgccacacgcgcctccgaaccgcccaccccgacaccgccccgcccgaacgcacgactccgccccacacgccgaaaccgactataccgtaaaaataacgcgcgaacgacgacctacgccaaaacgaacgcgacgaacgacgacgtaacgccgcacgcgaacgcgcgcgaaccgccgcgaccgc

SEQ ID NO: 39977 - DNA, 531 bp, Artificial Sequence
  chemically treated genomic DNA (Homo sapiens) CpG-island No: 39977
tgtgcgggtgggggggatatatttcgggtgcgcggtaggcggaaggggtaatggtaaagtgttgttttgggtatattcgatatgtgtgtgttgtttaaaagatataaagttgttgacgaatatttttacgtcggggttgtacggggaaacggggggggcgcggggtggtgggggggcgggtaataaaatagcggtttattcgcggagggtacgtttgtcgtagacgcgttaaggtggggtgtcggagacgatatcggaaaaaaacggggtgggggatgagtaaacgaataagagtgtaatattgtgtagcggtcgaagggtacgggggcggggtcggggggggtaatcgttgatttatcgtaagaatattgtcgggggcgtgggtcgaagcgcggaaataatatggggaacggttttgcgcggtggtttttacggacgcggagacggtatagcggtaaatatgagtaatttttttcgggattaggttataaacgaggtaagtggttgtggtggtgaagataaagggaaata

SEQ ID NO: 39978 - DNA, 531 bp, Artificial Sequence
  chemically treated genomic DNA (Homo sapiens) CpG-island No: 39978
tatttccctttatcttcaccaccacaaccacttacctcgtttataacctaatcccgaaaaaaattactcatatttaccgctataccgtctccgcgtccgtaaaaaccaccgcgcaaaaccgttccccatattatttccgcgcttcgacccacgcccccgacaatattcttacgataaatcaacgattaccccccccgaccccgcccccgtacccttcgaccgctacacaatattacactcttattcgtttactcatcccccaccccgtttttttccgatatcgtctccgacaccccaccttaacgcgtctacgacaaacgtaccctccgcgaataaaccgctattttattacccgcccccccaccaccccgcgccccccccgtttccccgtacaaccccgacgtaaaaatattcgtcaacaactttatatcttttaaacaacacacacatatcgaatatacccaaaacaacactttaccattaccccttccgcctaccgcgcacccgaaatatatcccccccacccgcaca

SEQ ID NO: 39979 - DNA, 531 bp, Artificial Sequence
  chemically treated genomic DNA (Homo sapiens) CpG-island No: 39979
tatttttttttatttttattattataattatttgtttcgtttgtggtttaatttcgaagaggattatttatgtttgtcgttgtgtcgttttcgcgttcgtggggattatcgcgtagggtcgttttttatgttgttttcgcgtttcgatttacgttttcggtaatgtttttacgatggattagcggttatttttttcgatttcgttttcgtatttttcggtcgttatatagtgttatatttttattcgtttgtttattttttatttcgttttttttcggtgtcgttttcggtattttattttaacgcgtttgcgataagcgtatttttcgcgagtagatcgttgttttgttattcgtttttttattatttcgcgtttttttcgttttttcgtgtagtttcggcgtgaaagtgttcgttagtagttttgtgttttttggataatatatatatgtcgggtatgtttaagataatattttattattatttttttcgtttatcgcgtattcggaatgtattttttttattcgtata

SEQ ID NO: 39980 - DNA, 531 bp, Artificial Sequence
  chemically treated genomic DNA (Homo sapiens) CpG-island No: 39980
tatacgaataaaaaaaatacattccgaatacgcgataaacgaaaaaaataataataaaatattatcttaaacatacccgacatatatatattatccaaaaaacacaaaactactaacgaacactttcacgccgaaactacacgaaaaaacgaaaaaaacgcgaaataataaaaaaacgaataacaaaacaacgatctactcgcgaaaaatacgcttatcgcaaacgcgttaaaataaaataccgaaaacgacaccgaaaaaaaacgaaataaaaaataaacaaacgaataaaaatataacactatataacgaccgaaaaatacgaaaacgaaatcgaaaaaaataaccgctaatccatcgtaaaaacattaccgaaaacgtaaatcgaaacgcgaaaacaacataaaaaacgaccctacgcgataatccccacgaacgcgaaaacgacacaacgacaaacataaataatcctcttcgaaattaaaccacaaacgaaacaaataattataataataaaaataaaaaaaaata

SEQ ID NO: 39981 - DNA, 608 bp, Artificial Sequence
  chemically treated genomic DNA (Homo sapiens) CpG-island No: 39981
gtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgtttggggttcgatcgtgaaacgttgttgggcggggtgaaagcgttgtttgtcggttttggaggtttttgggttggggatcggatttgcgggcggttttatgttcgcgttcgcgtg

SEQ ID NO: 39982 - DNA, 608 bp, Artificial Sequence
  chemically treated genomic DNA (Homo sapiens) CpG-island No: 39982
cacgcgaacgcgaacataaaaccgcccgcaaatccgatccccaacccaaaaacctccaaaaccgacaaacaacgctttcaccccgcccaacaacgtttcacgatcgaaccccaaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgac

SEQ ID NO: 39983 - DNA, 608 bp, Artificial Sequence
  chemically treated genomic DNA (Homo sapiens) CpG-island No: 39983
tacgcggacgcgggtatggagtcgttcgtagattcggtttttaatttagaaatttttaggatcggtaggtagcgtttttatttcgtttaataacgttttacggtcggattttaagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggt

SEQ ID NO: 39984 - DNA, 608 bp, Artificial Sequence
  chemically treated genomic DNA (Homo sapiens) CpG-island No: 39984
accgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatacttaaaatccgaccgtaaaacgttattaaacgaaataaaaacgctacctaccgatcctaaaaatttctaaattaaaaaccgaatctacgaacgactccatacccgcgtccgcgta

SEQ ID NO: 39985 - DNA, 518 bp, Artificial Sequence
  chemically treated genomic DNA (Homo sapiens) CpG-island No: 39985
  misc_feature (370)..(370): n is either a, c, g or t
ttcggtagttttatttattttttttttcgcgtttttttatcgtttttcgtttttttttcggtcggcgtttttgggttattagcgttttttaattttattttgttttcgttttgtttttattttgtcgttcgtcgcgcgtcgcgtttttttttttgtgttttttttatcgtcggtatgttcgttttattacgtatcgtcggcgttttttttacgttcggtatttgtcgtaggtcgtttatagggttttttttgtaatgatcgtcggagttataggtgttatatagagcgtaggagatagattatcgcgacgtcggtgttcgtttatcgatacgtgttttacgtttcgcgtcgtcgttgttgttgcgtcgtntgtttttgtcgttttcgtttcggtattttcgatatcgtttgtgttcgcggttatttttttcgttgttgtgtcgtcgtggtttttgcggagcgcgtcgttagtgtcgttggtcgtatggtggtattcgtttatgggcgttcgttatcgt

SEQ ID NO: 39986 - DNA, 518 bp, Artificial Sequence
  chemically treated genomic DNA (Homo sapiens) CpG-island No: 39986
  misc_feature (149)..(149): n is either a, c, g or t
acgataacgaacgcccataaacgaataccaccatacgaccaacgacactaacgacgcgctccgcaaaaaccacgacgacacaacaacgaaaaaaataaccgcgaacacaaacgatatcgaaaataccgaaacgaaaacgacaaaaacanacgacgcaacaacaacgacgacgcgaaacgtaaaacacgtatcgataaacgaacaccgacgtcgcgataatctatctcctacgctctatataacacctataactccgacgatcattacaaaaaaaaccctataaacgacctacgacaaataccgaacgtaaaaaaaacgccgacgatacgtaataaaacgaacataccgacgataaaaaaaacacaaaaaaaaaaacgcgacgcgcgacgaacgacaaaataaaaacaaaacgaaaacaaaataaaattaaaaaacgctaataacccaaaaacgccgaccgaaaaaaaaacgaaaaacgataaaaaaacgcgaaaaaaaaaataaataaaactaccgaa

SEQ ID NO: 39987 - DNA, 518 bp, Artificial Sequence
  chemically treated genomic DNA (Homo sapiens) CpG-island No: 39987
  misc_feature (149)..(149): n is either a, c, g or t
acggtggcgggcgtttatgagcgggtgttattatgcggttagcggtattggcggcgcgtttcgtagggattacggcgatataatagcggagggggtggtcgcgggtataaacggtatcgggggtatcggggcgggggcgataggggtangcggcgtaataatagcggcggcgcgaggcgtagagtacgtgtcggtaggcggatatcggcgtcgcggtggtttattttttgcgttttgtgtaatatttgtaatttcggcggttattgtagggggggttttgtgggcggtttgcgataggtatcgggcgtggggggggcgtcgacggtgcgtgatagggcgggtatgtcggcggtgggaaaaatataggggggagagcgcggcgcgcggcgaacggtaaagtgggggtagggcgaaaataaagtggggttaaggggcgttggtagtttaaaggcgtcgatcggaaggggaacggaaggcggtggaaaagcgcggggggaggggtgggtaagattgtcgag

SEQ ID NO: 39988 - DNA, 518 bp, Artificial Sequence
  chemically treated genomic DNA (Homo sapiens) CpG-island No: 39988
  misc_feature (370)..(370): n is either a, c, g or t
ctcgacaatcttacccacccctccccccgcgcttttccaccgccttccgttccccttccgatcgacgcctttaaactaccaacgccccttaaccccactttattttcgccctacccccactttaccgttcgccgcgcgccgcgctctcccccctatatttttcccaccgccgacatacccgccctatcacgcaccgtcgacgccccccccacgcccgatacctatcgcaaaccgcccacaaaaccccccctacaataaccgccgaaattacaaatattacacaaaacgcaaaaaataaaccaccgcgacgccgatatccgcctaccgacacgtactctacgcctcgcgccgccgctattattacgccgcntacccctatcgcccccgccccgatacccccgataccgtttatacccgcgaccaccccctccgctattatatcgccgtaatccctacgaaacgcgccgccaataccgctaaccgcataataacacccgctcataaacgcccgccaccgt

SEQ ID NO: 39989 - DNA, 555 bp, Artificial Sequence
  chemically treated genomic DNA (Homo sapiens) CpG-island No: 39989
cgtatcggggtggttcgatttggtggatacgtcgttgcgtagggaggatgtggaggttgaattttgttttatgggtatacgcgtagttttagtatagaagacggaaagcgatatgtggggttttagttacgtcggcgatatacgtttcgacgtttttatatttattcggttatttttcggttttggtacgcgcggagcggtaggtacggttttttaagcgcggaggatagtgggtgcggttcggatcggcggtgttggcggtgcggggcgatgggagcgcggggttgtcggcggcgcgcgggcgtggcggtcgggttgggcgtgcggggcggcgcgtttcgtgtgcgtttttcgcgcgtgcggtgcgttcgtggttcgtttcgcggggggagtgggggcgttcgcgggtgttcgacgtcgagttcgagacgtattatacggcgttcgtcgcggcgtagaaagtcgtcggttagtttagggtaggggaagggaagggaagggaagggaagggaagggagaaaagaaaaagacgagtgaattttatattaaagatag

SEQ ID NO: 39990 - DNA, 555 bp, Artificial Sequence
  chemically treated genomic DNA (Homo sapiens) CpG-island No: 39990
ctatctttaatataaaattcactcgtctttttcttttctcccttcccttcccttcccttcccttcccttcccctaccctaaactaaccgacgactttctacgccgcgacgaacgccgtataatacgtctcgaactcgacgtcgaacacccgcgaacgcccccactccccccgcgaaacgaaccacgaacgcaccgcacgcgcgaaaaacgcacacgaaacgcgccgccccgcacgcccaacccgaccgccacgcccgcgcgccgccgacaaccccgcgctcccatcgccccgcaccgccaacaccgccgatccgaaccgcacccactatcctccgcgcttaaaaaaccgtacctaccgctccgcgcgtaccaaaaccgaaaaataaccgaataaatataaaaacgtcgaaacgtatatcgccgacgtaactaaaaccccacatatcgctttccgtcttctatactaaaactacgcgtatacccataaaacaaaattcaacctccacatcctccctacgcaacgacgtatccaccaaatcgaaccaccccgatacg

SEQ ID NO: 39991 - DNA, 555 bp, Artificial Sequence
  chemically treated genomic DNA (Homo sapiens) CpG-island No: 39991
ttgtttttaatgtaagatttattcgtttttttttttttttttttttttttttttttttttttttttttttttttgttttaggttggtcggcgattttttacgtcgcggcgggcgtcgtgtggtgcgtttcgggttcggcgtcgggtattcgcgggcgtttttatttttttcgcgaagcgggttacgagcgtatcgtacgcgcggggggcgtatacggggcgcgtcgtttcgtacgtttagttcggtcgttacgttcgcgcgtcgtcggtagtttcgcgtttttatcgtttcgtatcgttaatatcgtcgattcggatcgtatttattatttttcgcgtttaagaggtcgtgtttgtcgtttcgcgcgtgttagggtcggaaagtaatcgggtaggtgtgaaggcgtcgaggcgtgtgtcgtcggcgtaattggggttttatatatcgtttttcgttttttgtattgagattgcgcgtgtgtttatggaataaaatttaatttttatattttttttacgtagcggcgtgtttattaggtcggattatttcgatgcg

SEQ ID NO: 39992 - DNA, 555 bp, Artificial Sequence
  chemically treated genomic DNA (Homo sapiens) CpG-island No: 39992
cgcatcgaaataatccgacctaataaacacgccgctacgtaaaaaaaatataaaaattaaattttattccataaacacacgcgcaatctcaatacaaaaaacgaaaaacgatatataaaaccccaattacgccgacgacacacgcctcgacgccttcacacctacccgattactttccgaccctaacacgcgcgaaacgacaaacacgacctcttaaacgcgaaaaataataaatacgatccgaatcgacgatattaacgatacgaaacgataaaaacgcgaaactaccgacgacgcgcgaacgtaacgaccgaactaaacgtacgaaacgacgcgccccgtatacgccccccgcgcgtacgatacgctcgtaacccgcttcgcgaaaaaaataaaaacgcccgcgaatacccgacgccgaacccgaaacgcaccacacgacgcccgccgcgacgtaaaaaatcgccgaccaacctaaaacaaaaaaaaaaaaaaaaaaaaaaaaaaaaaaaaaaaaaaaaaaaaaaaaacgaataaatcttacattaaaaacaa

SEQ ID NO: 39993 - DNA, 679 bp, Artificial Sequence
  chemically treated genomic DNA (Homo sapiens) CpG-island No: 39993
tcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgtgggtattcgttggcgttgatacgtcggcgttggatgagcgatcggcgttgtttgggttcgatcggaaacgtttgtgtgcggggtaaagttttttttgtcggtttgaggttttgggttgggacggattttggggggttggggcgtatcgggtttgtgtttcggttaggggttatgggttgggaaggtcggggttttatcggtttttcgggttacgtgtttttttataaattttgttagtttgagttattggttag

SEQ ID NO: 39994 - DNA, 679 bp, Artificial Sequence
  chemically treated genomic DNA (Homo sapiens) CpG-island No: 39994
ctaaccaataactcaaactaacaaaatttataaaaaaacacgtaacccgaaaaaccgataaaaccccgaccttcccaacccataacccctaaccgaaacacaaacccgatacgccccaaccccccaaaatccgtcccaacccaaaacctcaaaccgacaaaaaaaactttaccccgcacacaaacgtttccgatcgaacccaaacaacgccgatcgctcatccaacgccgacgtatcaacgccaacgaatacccacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccga

SEQ ID NO: 39995 - DNA, 679 bp, Artificial Sequence
  chemically treated genomic DNA (Homo sapiens) CpG-island No: 39995
ttggttaatggtttaagttggtaaagtttgtaaaaggatacgtaattcggaaagtcggtaaagtttcggtttttttaatttatgatttttggtcgaaatataaattcgatgcgttttagttttttaagattcgttttaatttaaaattttagatcggtagagagggttttatttcgtatataaacgttttcggtcggatttaggtaacgtcggtcgtttatttagcgtcgacgtgttaacgttagcgagtatttatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcga

SEQ ID NO: 39996 - DNA, 679 bp, Artificial Sequence
  chemically treated genomic DNA (Homo sapiens) CpG-island No: 39996
tcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatataaatactcgctaacgttaacacgtcgacgctaaataaacgaccgacgttacctaaatccgaccgaaaacgtttatatacgaaataaaaccctctctaccgatctaaaattttaaattaaaacgaatcttaaaaaactaaaacgcatcgaatttatatttcgaccaaaaatcataaattaaaaaaaccgaaactttaccgactttccgaattacgtatccttttacaaactttaccaacttaaaccattaaccaa

SEQ ID NO: 39997 - DNA, 577 bp, Artificial Sequence
  chemically treated genomic DNA (Homo sapiens) CpG-island No: 39997
gtttagcgttgtggcggcgtggggatatttgcggcggtcgtagtttcgttttcgcgttttttttttttttttttttttttttttttttttttttcgcgtttttattcgcgcggttcgcgttaggtttaggttttttatgattttttcgaaggtcgtcgtttttttcgtttgtttttggttgtgtagtgcgattttttcgttaaattttcgcggattgttcgaagtcgttattttttcgtcgtttttttttttttttattttttttttattttttggttttttttattttcgggagttatcgcgtaggcgtcggtcgggtttacggtcggagagaacgcgtatgttgtaagtacggtttagagcgtggtttcggcgcgcgggagaggcgtgtggcgttggggtgaatacgtttgcgcgtgtttgggtaacgcgtcgggagtttgggaggggcgtgtttacgtaggcgtattgtagtgcgcgtggttcgttggatagcggttcgggttttgttttattagcgagggatttgagtggtagaggatacggtagaattgatgtttgtatttattggatttta

SEQ ID NO: 39998 - DNA, 577 bp, Artificial Sequence
  chemically treated genomic DNA (Homo sapiens) CpG-island No: 39998
taaaatccaataaatacaaacatcaattctaccgtatcctctaccactcaaatccctcgctaataaaacaaaacccgaaccgctatccaacgaaccacgcgcactacaatacgcctacgtaaacacgcccctcccaaactcccgacgcgttacccaaacacgcgcaaacgtattcaccccaacgccacacgcctctcccgcgcgccgaaaccacgctctaaaccgtacttacaacatacgcgttctctccgaccgtaaacccgaccgacgcctacgcgataactcccgaaaataaaaaaaaccaaaaaataaaaaaaaaataaaaaaaaaaaaaaacgacgaaaaaataacgacttcgaacaatccgcgaaaatttaacgaaaaaatcgcactacacaaccaaaaacaaacgaaaaaaacgacgaccttcgaaaaaatcataaaaaacctaaacctaacgcgaaccgcgcgaataaaaacgcgaaaaaaaaaaaaaaaaaaaaaaaaaaaaaaaaaaaaaacgcgaaaacgaaactacgaccgccgcaaatatccccacgccgccacaacgctaaac

SEQ ID NO: 39999 - DNA, 577 bp, Artificial Sequence
  chemically treated genomic DNA (Homo sapiens) CpG-island No: 39999
tggagtttagtgaatgtaggtattagttttgtcgtgttttttgttatttaagtttttcgttgatgggataggattcggatcgttgtttagcgaattacgcgtattgtagtgcgtttgcgtaggtacgttttttttaggttttcgacgcgttgtttaggtacgcgtaggcgtgtttattttaacgttatacgtttttttcgcgcgtcggagttacgttttgggtcgtgtttgtagtatgcgcgtttttttcggtcgtgggttcggtcggcgtttgcgcggtggttttcgagagtggggggggttaggaggtggaggaggagtaggagaaggaggaggcggcgagaagatggcgatttcgaataattcgcggaaatttagcgagaagatcgtattgtataattagaagtaggcggaggagacggcggttttcgaggaggttatgaaggatttgagtttgacgcgggtcgcgcgggtgagagcgcgggggaggggaggggaggagggaggggaggaggaagagacgcgggggcggggttgcggtcgtcgtaggtgtttttacgtcgttatagcgttgagt

SEQ ID NO: 40000 - DNA, 577 bp, Artificial Sequence
  chemically treated genomic DNA (Homo sapiens) CpG-island No: 40000
actcaacgctataacgacgtaaaaacacctacgacgaccgcaaccccgcccccgcgtctcttcctcctcccctccctcctcccctcccctcccccgcgctctcacccgcgcgacccgcgtcaaactcaaatccttcataacctcctcgaaaaccgccgtctcctccgcctacttctaattatacaatacgatcttctcgctaaatttccgcgaattattcgaaatcgccatcttctcgccgcctcctccttctcctactcctcctccacctcctaaccccccccactctcgaaaaccaccgcgcaaacgccgaccgaacccacgaccgaaaaaaacgcgcatactacaaacacgacccaaaacgtaactccgacgcgcgaaaaaaacgtataacgttaaaataaacacgcctacgcgtacctaaacaacgcgtcgaaaacctaaaaaaaacgtacctacgcaaacgcactacaatacgcgtaattcgctaaacaacgatccgaatcctatcccatcaacgaaaaacttaaataacaaaaaacacgacaaaactaatacctacattcactaaactcca

SEQ ID NO: 40001 - DNA, 736 bp, Artificial Sequence
  chemically treated genomic DNA (Homo sapiens) CpG-island No: 40001
tggttttcgggggtatattttatatcgatagcgatcgagttgttagtagtaaggtgttttagttatttgagttaggagtacgttattttcgcgagtttacggagatggaattgggttgtagttacgcgggcgtggttgtgttggataatttcgtgtacgtggtaggcggttagtatttgtagtatcgtagtggcgaaggcgttgtggacgtttgttatcgttatgatttatagcgtaatcgttggttgcggttgcgagtattgcgtgagagtcgcgtgtagttttagtttattgtattgggagggttgttgtatgttatcggtggtcgaaatcgcgcgggtagtttggcgtttgtggagcgttattgtttacgtcgtgatagttgggattttgtttgtttatttaagcgtcgtatttggggttatgcgggtgtcgtagttgttggtcgtttttatattttaggtggttatggcgttttagcggaggataagaaggcgttgtagtgttatgatttagtagtcgatcgttgggagtttagggcgtttatgcgtgagtttcgcgtgttgtacgtaatgttgggcgttgttggtcgtatttatgttttaggtggtcgtatggattacgtggatcgttgtttcgatgtgttggttgtggagtattacgtgtcggatgtcgattagtggattagtgtgatatttatgcgagttggttagtcggaagttggttgttgtttatt

SEQ ID NO: 40002 - DNA, 736 bp, Artificial Sequence
  chemically treated genomic DNA (Homo sapiens) CpG-island No: 40002
aataaacaacaaccaacttccgactaaccaactcgcataaatatcacactaatccactaatcgacatccgacacgtaatactccacaaccaacacatcgaaacaacgatccacgtaatccatacgaccacctaaaacataaatacgaccaacaacgcccaacattacgtacaacacgcgaaactcacgcataaacgccctaaactcccaacgatcgactactaaatcataacactacaacgccttcttatcctccgctaaaacgccataaccacctaaaatataaaaacgaccaacaactacgacacccgcataaccccaaatacgacgcttaaataaacaaacaaaatcccaactatcacgacgtaaacaataacgctccacaaacgccaaactacccgcgcgatttcgaccaccgataacatacaacaaccctcccaatacaataaactaaaactacacgcgactctcacgcaatactcgcaaccgcaaccaacgattacgctataaatcataacgataacaaacgtccacaacgccttcgccactacgatactacaaatactaaccgcctaccacgtacacgaaattatccaacacaaccacgcccgcgtaactacaacccaattccatctccgtaaactcgcgaaaataacgtactcctaactcaaataactaaaacaccttactactaacaactcgatcgctatcgatataaaatatacccccgaaaacca

SEQ ID NO: 40003 - DNA, 736 bp, Artificial Sequence
  chemically treated genomic DNA (Homo sapiens) CpG-island No: 40003
agtagatagtagttagttttcgattgattagttcgtatgggtgttatattggtttattggtcggtattcggtacgtagtattttatagttagtatatcgaagtagcggtttacgtggtttatgcggttatttagggtatagatgcggttagtagcgtttaatattgcgtgtagtacgcggggtttacgtatgggcgttttgggtttttagcggtcggttgttggattatagtattgtagcgtttttttgtttttcgttgagacgttataattatttgagatgtagaggcgattagtagttgcggtattcgtatggttttaggtacggcgtttgagtgggtaggtaaaattttagttgttacggcgtgggtagtagcgttttatagacgttaggttgttcgcgcgatttcggttatcggtggtatataatagtttttttagtgtagtgagttggaattgtacgcggtttttacgtagtgttcgtagtcgtagttagcgattgcgttgtggattatagcggtagtaggcgtttatagcgttttcgttattgcggtgttgtagatgttggtcgtttgttacgtatacgaagttatttagtatagttacgttcgcgtggttatagtttagttttattttcgtgagttcgcggaagtggcgtgtttttggtttaggtaattggaatattttgttgttgatagttcggtcgttgtcggtataaggtgtgttttcgaaggtta

SEQ ID NO: 40004 - DNA, 736 bp, Artificial Sequence
  chemically treated genomic DNA (Homo sapiens) CpG-island No: 40004
taaccttcgaaaacacaccttataccgacaacgaccgaactatcaacaacaaaatattccaattacctaaaccaaaaacacgccacttccgcgaactcacgaaaataaaactaaactataaccacgcgaacgtaactatactaaataacttcgtatacgtaacaaacgaccaacatctacaacaccgcaataacgaaaacgctataaacgcctactaccgctataatccacaacgcaatcgctaactacgactacgaacactacgtaaaaaccgcgtacaattccaactcactacactaaaaaaactattatataccaccgataaccgaaatcgcgcgaacaacctaacgtctataaaacgctactacccacgccgtaacaactaaaattttacctacccactcaaacgccgtacctaaaaccatacgaataccgcaactactaatcgcctctacatctcaaataattataacgtctcaacgaaaaacaaaaaaacgctacaatactataatccaacaaccgaccgctaaaaacccaaaacgcccatacgtaaaccccgcgtactacacgcaatattaaacgctactaaccgcatctataccctaaataaccgcataaaccacgtaaaccgctacttcgatatactaactataaaatactacgtaccgaataccgaccaataaaccaatataacacccatacgaactaatcaatcgaaaactaactactatctact

SEQ ID NO: 40005 - DNA, 536 bp, Artificial Sequence
  chemically treated genomic DNA (Homo sapiens) CpG-island No: 40005
  misc_feature (403)..(403): n is either a, c, g or t
  misc_feature (517)..(517): n is either a, c, g or t
gggtttttttgcggtgggtcgttttttcgggggttcgttttcggcgtcgtcggcggtttttttttttcggggtttcgggcgttttcgtttttttcgcggcgttttttttttttttgtcgttttttttttttcgcgtttgtttttttgttttttggttttcgttttttttcgttttcgcgggcggttgtttgcggttcgcgttgttttttttttttcgtttttcgtcgcgcggtcgcgcgcgcgcgtttcgcgttgttggtcgggcgtcgtttggtcgcgggggggttgtgttggtcgcggtttttgttcgttttttcgggggtcgcggtcgcgcgtttgcgtcggcgcgtcggtcgcggggtcggcgttcggttgcgttgtcgtggttcgcgcgggttcgggncgcgtttggtggcggtggcgtggcgttcgtcgcgtttttttttgtgtcgtttttgtttcgttcgtcgggggttttcggtcgtttttcggcgttgtttcgtttttttcgggcggnggttcgtgcgggcggcgtt

SEQ ID NO: 40006 - DNA, 536 bp, Artificial Sequence
  chemically treated genomic DNA (Homo sapiens) CpG-island No: 40006
  misc_feature (20)..(20): n is either a, c, g or t
  misc_feature (134)..(134): n is either a, c, g or t
aacgccgcccgcacgaaccnccgcccgaaaaaaacgaaacaacgccgaaaaacgaccgaaaacccccgacgaacgaaacaaaaacgacacaaaaaaaaacgcgacgaacgccacgccaccgccaccaaacgcgncccgaacccgcgcgaaccacgacaacgcaaccgaacgccgaccccgcgaccgacgcgccgacgcaaacgcgcgaccgcgacccccgaaaaaacgaacaaaaaccgcgaccaacacaacccccccgcgaccaaacgacgcccgaccaacaacgcgaaacgcgcgcgcgcgaccgcgcgacgaaaaacgaaaaaaaaaaaacaacgcgaaccgcaaacaaccgcccgcgaaaacgaaaaaaaacgaaaaccaaaaaacaaaaaaacaaacgcgaaaaaaaaaaaacgacaaaaaaaaaaaaaacgccgcgaaaaaaacgaaaacgcccgaaaccccgaaaaaaaaaaaccgccgacgacgccgaaaacgaacccccgaaaaaacgacccaccgcaaaaaaaccc

SEQ ID NO: 40007 - DNA, 536 bp, Artificial Sequence
  chemically treated genomic DNA (Homo sapiens) CpG-island No: 40007
  misc_feature (20)..(20): n is either a, c, g or t
  misc_feature (134)..(134): n is either a, c, g or t
ggcgtcgttcgtacgggttntcgttcggagagggcgagatagcgtcgggaggcggtcggagattttcggcgagcgggataaaagcgatataaggagaggcgcggcgagcgttacgttatcgttattagacgcgnttcgggttcgcgcggattacgatagcgtagtcgggcgtcggtttcgcgatcggcgcgtcggcgtaggcgcgcgatcgcggttttcgggagggcgggtaaggatcgcggttagtataattttttcgcggttaagcggcgttcggttagtagcgcgaggcgcgcgcgcgcgatcgcgcggcggaggacgaggagagggaggtagcgcgagtcgtaggtagtcgttcgcgggagcggagaggagcgggagttagagggtagggaggtaggcgcgagaggaggagagcgataggaagaggaagaacgtcgcgaggagggcggaagcgttcggagtttcgagggagaggagtcgtcggcggcgtcggagacgaattttcggagagacggtttatcgtaggggaattt

SEQ ID NO: 40008 - DNA, 536 bp, Artificial Sequence
  chemically treated genomic DNA (Homo sapiens) CpG-island No: 40008
  misc_feature (403)..(403): n is either a, c, g or t
  misc_feature (517)..(517): n is either a, c, g or t
aaattcccctacgataaaccgtctctccgaaaattcgtctccgacgccgccgacgactcctctccctcgaaactccgaacgcttccgccctcctcgcgacgttcttcctcttcctatcgctctcctcctctcgcgcctacctccctaccctctaactcccgctcctctccgctcccgcgaacgactacctacgactcgcgctacctccctctcctcgtcctccgccgcgcgatcgcgcgcgcgcgcctcgcgctactaaccgaacgccgcttaaccgcgaaaaaattatactaaccgcgatccttacccgccctcccgaaaaccgcgatcgcgcgcctacgccgacgcgccgatcgcgaaaccgacgcccgactacgctatcgtaatccgcgcgaacccgaancgcgtctaataacgataacgtaacgctcgccgcgcctctccttatatcgcttttatcccgctcgccgaaaatctccgaccgcctcccgacgctatctcgccctctccgaacganaacccgtacgaacgacgcc

SEQ ID NO: 40009 - DNA, 587 bp, Artificial Sequence
  chemically treated genomic DNA (Homo sapiens) CpG-island No: 40009
tttttttttagatttaatcggtttttttcggtatttacggttcggtttttatttttggtttcgttcggtttttttttttttttcgtttaatttttattttacgttttatttttcgttttttttcggttttcgtttcgaatagcgtttttttttttcgttttttttttttttcgttttagttcgtttttttgtttatttcgtagcggtatttttcgtttttttttttaatttttttttttcgattatttttcgttattttttcgtacgtttttttttttcgggtttttttgtttttatacgcgttttcgagattttcgatcgtatatatatattttttcgttttttttttttttttacgttttatatttatttttcgtttttttgatttttcgttttttttttttcgcgtttaggatatttttttattataaattttcgagggttttataatattttttttttttttcgaacggttttttttttttaaaatattttttataaattttttgtttagttttacgttttcgtttttttttattttttcgtttagttttttttaaaggttttttatttttttttttagcgta

SEQ ID NO: 40010 - DNA, 587 bp, Artificial Sequence
  chemically treated genomic DNA (Homo sapiens) CpG-island No: 40010
tacgctaaaaaaaaaaataaaaaacctttaaaaaaaactaaacgaaaaaataaaaaaaaacgaaaacgtaaaactaaacaaaaaatttataaaaaatattttaaaaaaaaaaaaccgttcgaaaaaaaaaaaaaatattataaaaccctcgaaaatttataataaaaaaatatcctaaacgcgaaaaaaaaaaaacgaaaaatcaaaaaaacgaaaaataaatataaaacgtaaaaaaaaaaaaaaaacgaaaaaatatatatatacgatcgaaaatctcgaaaacgcgtataaaaacaaaaaaacccgaaaaaaaaaaacgtacgaaaaaataacgaaaaataatcgaaaaaaaaaaattaaaaaaaaaaacgaaaaataccgctacgaaataaacaaaaaaacgaactaaaacgaaaaaaaaaaaaaacgaaaaaaaaaaacgctattcgaaacgaaaaccgaaaaaaaacgaaaaataaaacgtaaaataaaaattaaacgaaaaaaaaaaaaaaaccgaacgaaaccaaaaataaaaaccgaaccgtaaataccgaaaaaaaccgattaaatctaaaaaaaaa

SEQ ID NO: 40011 - DNA, 587 bp, Artificial Sequence
  chemically treated genomic DNA (Homo sapiens) CpG-island No: 40011
tgcgttgggagaagggatggggggtttttggggggggttgggcgggagagtagaggggggcgggggcgtggaattgggtaaggagtttgtggagggtgttttgggggagggaaatcgttcggggagagggagaggtgttgtggagttttcgagagtttgtggtgagagagtgttttgggcgcggggggagagaggcgggaggttagagaagcgaggggtgggtgtagggcgtaggggaggaggggggacgagagagtgtgtgtgtgcggtcgagagtttcgagagcgcgtgtgggggtagagaagttcggggagaggaggcgtgcggaaaggtggcggaaggtggtcggaggagagaggttggaggggggagcggaaagtgtcgttgcggagtggataggaagacgggttgagacggggggagggagaggcgaggaggagaggcgttgttcggggcggaggtcgaggagaggcggggggtgaagcgtggagtggaggttgggcgagggaagggggagggtcgggcggggttaggagtgaaggtcgggtcgtggatgtcgggaggggtcggttgagtttgggggaagg

SEQ ID NO: 40012 - DNA, 587 bp, Artificial Sequence
  chemically treated genomic DNA (Homo sapiens) CpG-island No: 40012
ccttcccccaaactcaaccgacccctcccgacatccacgacccgaccttcactcctaaccccgcccgaccctcccccttccctcgcccaacctccactccacgcttcaccccccgcctctcctcgacctccgccccgaacaacgcctctcctcctcgcctctccctccccccgtctcaacccgtcttcctatccactccgcaacgacactttccgctcccccctccaacctctctcctccgaccaccttccgccacctttccgcacgcctcctctccccgaacttctctacccccacacgcgctctcgaaactctcgaccgcacacacacactctctcgtcccccctcctcccctacgccctacacccacccctcgcttctctaacctcccgcctctctccccccgcgcccaaaacactctctcaccacaaactctcgaaaactccacaacacctctccctctccccgaacgatttccctcccccaaaacaccctccacaaactccttacccaattccacgcccccgcccccctctactctcccgcccaaccccccccaaaaaccccccatcccttctcccaacgca

SEQ ID NO: 40013 - DNA, 513 bp, Artificial Sequence
  chemically treated genomic DNA (Homo sapiens) CpG-island No: 40013
cgtcggtaaagggtagaattaatgaagggtttacgggggttgggatttaggcggtttgttcgtgtcgcgtattttcggttttcgtcggaagttgtttagcgtatcgtcgagtttttgggttttttacgtcgttcgttagtgcggggtttagtatagtttattttgtagttttaggtttcgttgtcgtagtttggtatttcgtttttcgatttttttgcgtaggagttttatttgtaattgcgatattttgttaggtcgtttagtcgtttgtatcgagatagatgtacgtgcgtaattgtaagtcggaagtgtatcgttggagtttgcggattcgcggggcggaaatgtttcgggcggaaatagtttttggtgagagttgggttttttttggagatcgaattttttgtagcgttttttggcgattggaggacgattcgttgtgaattcgttcgttttgttaatggttttagagttttataaattaagattgtataataaaaaagtcgattggaa

SEQ ID NO: 40014 - DNA, 513 bp, Artificial Sequence
  chemically treated genomic DNA (Homo sapiens) CpG-island No: 40014
ttccaatcgacttttttattatacaatcttaatttataaaactctaaaaccattaacaaaacgaacgaattcacaacgaatcgtcctccaatcgccaaaaaacgctacaaaaaattcgatctccaaaaaaaacccaactctcaccaaaaactatttccgcccgaaacatttccgccccgcgaatccgcaaactccaacgatacacttccgacttacaattacgcacgtacatctatctcgatacaaacgactaaacgacctaacaaaatatcgcaattacaaataaaactcctacgcaaaaaaatcgaaaaacgaaataccaaactacgacaacgaaacctaaaactacaaaataaactatactaaaccccgcactaacgaacgacgtaaaaaacccaaaaactcgacgatacgctaaacaacttccgacgaaaaccgaaaatacgcgacacgaacaaaccgcctaaatcccaacccccgtaaacccttcattaattctaccctttaccgacg

SEQ ID NO: 40015 - DNA, 513 bp, Artificial Sequence
  chemically treated genomic DNA (Homo sapiens) CpG-island No: 40015
ttttaatcggtttttttattgtgtagttttggtttgtaaaattttggggttattagtaaggcgaacgggtttataacgagtcgttttttagtcgttagggggcgttgtaggaaattcggtttttaaagggaatttagtttttattaggaattgttttcgttcgaagtattttcgtttcgcgggttcgtaggttttagcggtatattttcgatttgtaattgcgtacgtgtatttgtttcggtgtagacggttgggcggtttggtaagatgtcgtagttatagatgaaatttttgcgtaggaagatcgagaagcggaatgttaagttgcggtagcgaaatttgaagttgtaaggtgagttgtgttgaatttcgtattggcgaacgacgtggggaatttaggaattcggcggtgcgttgggtagttttcggcgggagtcggggatgcgcggtacgagtaggtcgtttgggttttagttttcgtggattttttattggttttgttttttgtcggcg

SEQ ID NO: 40016 - DNA, 513 bp, Artificial Sequence
  chemically treated genomic DNA (Homo sapiens) CpG-island No: 40016
cgccgacaaaaaacaaaaccaataaaaaatccacgaaaactaaaacccaaacgacctactcgtaccgcgcatccccgactcccgccgaaaactacccaacgcaccgccgaattcctaaattccccacgtcgttcgccaatacgaaattcaacacaactcaccttacaacttcaaatttcgctaccgcaacttaacattccgcttctcgatcttcctacgcaaaaatttcatctataactacgacatcttaccaaaccgcccaaccgtctacaccgaaacaaatacacgtacgcaattacaaatcgaaaatataccgctaaaacctacgaacccgcgaaacgaaaatacttcgaacgaaaacaattcctaataaaaactaaattccctttaaaaaccgaatttcctacaacgccccctaacgactaaaaaacgactcgttataaacccgttcgccttactaataaccccaaaattttacaaaccaaaactacacaataaaaaaaccgattaaaa

SEQ ID NO: 40017 - DNA, 523 bp, Artificial Sequence
  chemically treated genomic DNA (Homo sapiens) CpG-island No: 40017
  misc_feature (120)..(120): n is either a, c, g or t
  misc_feature (135)..(135): n is either a, c, g or t
  misc_feature (465)..(465): n is either a, c, g or t
tgtgtgtaggtgcgggtgtgtgggtttcgatgtgcgggtgcgggtgtgtaagtatcggtgtgcgggtatcggtgtgcgggtgtgtgaatgtgggtgcgggtgtgcgggtgtgtgaatgtngatttcggtgtgttngtgtcggggtgtcgtggtgtgggtgtcggtgtgtgggtttttaattttcggtgtttaagttcggtattgcgggttcggggttgtcggttttcgggttttttttttttcgcggtggtttttggggtttggacgcgggtagtcggtggagcgggtgatttcggttttgtttggtcgtcgcgcggttgttggttgtttttcgtttttttcgtgtttcgtattgtatttttcgggtgtcgcggcgttgtcgatagagggtgttcgggtgtgtggagcgtggtggggcgtagttggagggtggcggtgcgcgagaggcgggcgtcggttattttnacgggtttacgtcgttcgtttttcggtgaattgtgcgttgatgcggacggagcgtagg

SEQ ID NO: 40018 - DNA, 523 bp, Artificial Sequence
  chemically treated genomic DNA (Homo sapiens) CpG-island No: 40018
  misc_feature (59)..(59): n is either a, c, g or t
  misc_feature (389)..(389): n is either a, c, g or t
  misc_feature (404)..(404): n is either a, c, g or t
cctacgctccgtccgcatcaacgcacaattcaccgaaaaacgaacgacgtaaacccgtnaaaataaccgacgcccgcctctcgcgcaccgccaccctccaactacgccccaccacgctccacacacccgaacaccctctatcgacaacgccgcgacacccgaaaaatacaatacgaaacacgaaaaaaacgaaaaacaaccaacaaccgcgcgacgaccaaacaaaaccgaaatcacccgctccaccgactacccgcgtccaaaccccaaaaaccaccgcgaaaaaaaaaaaacccgaaaaccgacaaccccgaacccgcaataccgaacttaaacaccgaaaattaaaaacccacacaccgacacccacaccacgacaccccgacacnaacacaccgaaatcnacattcacacacccgcacacccgcacccacattcacacacccgcacaccgatacccgcacaccgatacttacacacccgcacccgcacatcgaaacccacacacccgcacctacacaca

SEQ ID NO: 40019 - DNA, 523 bp, Artificial Sequence
  chemically treated genomic DNA (Homo sapiens) CpG-island No: 40019
  misc_feature (59)..(59): n is either a, c, g or t
  misc_feature (389)..(389): n is either a, c, g or t
  misc_feature (404)..(404): n is either a, c, g or t
tttgcgtttcgttcgtattagcgtatagtttatcggagaacgaacggcgtagattcgtnggagtaatcggcgttcgtttttcgcgtatcgttattttttagttacgttttattacgttttatatattcggatattttttgtcgatagcgtcgcgatattcgagagatataatacgaagtacggaaggagcgaggagtagttagtagtcgcgcggcgattaggtagggtcgggattattcgttttatcggttattcgcgtttaagttttagaaattatcgcgaaagaggggggattcgagaatcggtaatttcgaattcgtaatgtcgaatttagatatcgggagttggaaatttatatatcggtatttatattacggtatttcggtatngatatatcggaattnatatttatatattcgtatattcgtatttatatttatatattcgtatatcggtattcgtatatcggtatttgtatattcgtattcgtatatcggaatttatatattcgtatttgtatata

SEQ ID NO: 40020 - DNA, 523 bp, Artificial Sequence
  chemically treated genomic DNA (Homo sapiens) CpG-island No: 40020
  misc_feature (120)..(120): n is either a, c, g or t
  misc_feature (135)..(135): n is either a, c, g or t
  misc_feature (465)..(465): n is either a, c, g or t
tatatacaaatacgaatatataaattccgatatacgaatacgaatatacaaataccgatatacgaataccgatatacgaatatataaatataaatacgaatatacgaatatataaatatnaattccgatatatcnataccgaaataccgtaatataaataccgatatataaatttccaactcccgatatctaaattcgacattacgaattcgaaattaccgattctcgaatcccccctctttcgcgataatttctaaaacttaaacgcgaataaccgataaaacgaataatcccgaccctacctaatcgccgcgcgactactaactactcctcgctccttccgtacttcgtattatatctctcgaatatcgcgacgctatcgacaaaaaatatccgaatatataaaacgtaataaaacgtaactaaaaaataacgatacgcgaaaaacgaacgccgattactccnacgaatctacgccgttcgttctccgataaactatacgctaatacgaacgaaacgcaaa

SEQ ID NO: 40021 - DNA, 536 bp, Artificial Sequence
  chemically treated genomic DNA (Homo sapiens) CpG-island No: 40021
cgcggtatggagtttttcgattcgatttagtttttcgagacgttcgggtttgttgtcgaaagttttataatgtttttatgtataggcgatttcgtaacgttcgtcgttaatttttacgcgtaatttagttgagtaaaatcggagttaaattatattttttggagggttaaggattagtattcgatggatatttttttgcgtaggtacgtttttcgacgattgacgcgtcgtcgcgattgaatcgtaagtaattcgcgacggtgtcgacgtatcgtatattggcgaaatataggaggtatacgaagtttgcgatagacgcgtgtataagagtttcgcgtataggttttatacgtataggttcgttcggtagtgttatagacgttcgacgcgaatagagtatacgtcgttgtttaatagatagtacgattatcgattatattacgcgtatagtagtcgtaagttcgatatgatgtcgtagcggtattcgcgttatttttacgggcggagatagtatttattattacgcggatatatat

SEQ ID NO: 40022 - DNA, 536 bp, Artificial Sequence
  chemically treated genomic DNA (Homo sapiens) CpG-island No: 40022
atatatatccgcgtaataataaatactatctccgcccgtaaaaataacgcgaataccgctacgacatcatatcgaacttacgactactatacgcgtaatataatcgataatcgtactatctattaaacaacgacgtatactctattcgcgtcgaacgtctataacactaccgaacgaacctatacgtataaaacctatacgcgaaactcttatacacgcgtctatcgcaaacttcgtatacctcctatatttcgccaatatacgatacgtcgacaccgtcgcgaattacttacgattcaatcgcgacgacgcgtcaatcgtcgaaaaacgtacctacgcaaaaaaatatccatcgaatactaatccttaaccctccaaaaaatataatttaactccgattttactcaactaaattacgcgtaaaaattaacgacgaacgttacgaaatcgcctatacataaaaacattataaaactttcgacaacaaacccgaacgtctcgaaaaactaaatcgaatcgaaaaactccataccgcg

SEQ ID NO: 40023 - DNA, 536 bp, Artificial Sequence
  chemically treated genomic DNA (Homo sapiens) CpG-island No: 40023
gtgtgtgttcgcgtggtgatagatgttgttttcgttcgtgggagtggcgcgagtatcgttgcggtattatgtcgggtttacggttattgtgcgcgtagtgtggtcggtaatcgtgttgtttgttgagtagcggcgtgtattttgttcgcgtcgagcgtttgtagtattgtcgagcgagtttgtacgtgtggaatttgtacgcgagatttttgtgtacgcgtttgtcgtaagtttcgtatgttttttgtgtttcgttagtgtgcgatgcgtcggtatcgtcgcgggttgtttacggtttaatcgcgacggcgcgttagtcgtcgaaaagcgtgtttgcgtaaaagggtgtttatcgggtgttgatttttggttttttagaaagtgtggtttgatttcgattttatttagttggattgcgcgtgaaagttgacggcgagcgttgcggggtcgtttgtgtatgggggtattgtaaggttttcgatagtaggttcgagcgtttcgaggagttaggtcgggtcgaagggttttatatcgcg

SEQ ID NO: 40024 - DNA, 536 bp, Artificial Sequence
  chemically treated genomic DNA (Homo sapiens) CpG-island No: 40024
cgcgatataaaacccttcgacccgacctaactcctcgaaacgctcgaacctactatcgaaaaccttacaatacccccatacacaaacgaccccgcaacgctcgccgtcaactttcacgcgcaatccaactaaataaaatcgaaatcaaaccacactttctaaaaaaccaaaaatcaacacccgataaacacccttttacgcaaacacgcttttcgacgactaacgcgccgtcgcgattaaaccgtaaacaacccgcgacgataccgacgcatcgcacactaacgaaacacaaaaaacatacgaaacttacgacaaacgcgtacacaaaaatctcgcgtacaaattccacacgtacaaactcgctcgacaatactacaaacgctcgacgcgaacaaaatacacgccgctactcaacaaacaacacgattaccgaccacactacgcgcacaataaccgtaaacccgacataataccgcaacgatactcgcgccactcccacgaacgaaaacaacatctatcaccacgcgaacacacac

SEQ ID NO: 40025 - DNA, 632 bp, Artificial Sequence
  chemically treated genomic DNA (Homo sapiens) CpG-island No: 40025
ttcggttaacgttgtcgtcggtgaagattttcggtagtaagatcgttttgtcgtttatggataagtttagtgttatgacgttaattatagtgttgtttgcgttcgattattttattatttataattatgagggtattcgattattttgtatttagatgtaggttacggcggaatatattaagagaggtttcgtttaagtatttgtttattattattttttcgtcggtcgtattttttgcgacgacgacggcggcgatttttatatcgattgtatcggcgaggagttcggagcgacgttcgcgtgttatcgataattagtttattgacgtcgagacggcggtggtgtagtagttcgtttttaattgtacgttcgacgacgattatttattttattgtttgttgtgggtgtaggttattacgttgttttgcggaggtttcgtcgtcggggtgatatggaattatgtcgtggttgatggtttcggtatagtatagtttatataagtcgtcggcgagttcgttcgtggtttgttatcggcgtcgttcgttattttagttaggttagatgattaaaataacgtcgtttttttttttattatggtttttatgtagttagtagataggtataaggtatt

SEQ ID NO: 40026 - DNA, 632 bp, Artificial Sequence
  chemically treated genomic DNA (Homo sapiens) CpG-island No: 40026
aataccttatacctatctactaactacataaaaaccataataaaaaaaaaaacgacgttattttaatcatctaacctaactaaaataacgaacgacgccgataacaaaccacgaacgaactcgccgacgacttatataaactatactataccgaaaccatcaaccacgacataattccatatcaccccgacgacgaaacctccgcaaaacaacgtaataacctacacccacaacaaacaataaaataaataatcgtcgtcgaacgtacaattaaaaacgaactactacaccaccgccgtctcgacgtcaataaactaattatcgataacacgcgaacgtcgctccgaactcctcgccgatacaatcgatataaaaatcgccgccgtcgtcgtcgcaaaaaatacgaccgacgaaaaaataataataaacaaatacttaaacgaaacctctcttaatatattccgccgtaacctacatctaaatacaaaataatcgaataccctcataattataaataataaaataatcgaacgcaaacaacactataattaacgtcataacactaaacttatccataaacgacaaaacgatcttactaccgaaaatcttcaccgacgacaacgttaaccgaa

SEQ ID NO: 40027 - DNA, 632 bp, Artificial Sequence
  chemically treated genomic DNA (Homo sapiens) CpG-island No: 40027
ggtattttgtgtttgtttgttaattgtatgaaggttatggtgaagggagaaacggcgttgttttggttatttaatttgattggggtgacggacggcgtcgatggtaggttacgggcgagttcgtcgacggtttgtatgaattgtgttatgtcgaaattattagttacggtatggttttatgttatttcgacgacgaagttttcgtaggatagcgtggtgatttgtatttatagtagatagtgaggtaggtggtcgtcgtcgggcgtgtagttgaaggcgagttgttgtattatcgtcgtttcggcgttagtgggttggttgtcgatgatacgcgaacgtcgtttcgagtttttcgtcggtgtagtcgatgtaaaaatcgtcgtcgtcgtcgtcgtaggaaatgcggtcggcgaaaggatagtagtggataagtgtttgagcgagattttttttgatgtatttcgtcgtggtttgtatttgaatgtaggatgatcggatgtttttatggttatggatgatgggatggtcgaacgtaagtagtattgtggttggcgttatggtattaagtttgtttataggcgatagaacgattttgttgtcggaagtttttatcggcggtagcgttggtcgga

SEQ ID NO: 40028 - DNA, 632 bp, Artificial Sequence
  chemically treated genomic DNA (Homo sapiens) CpG-island No: 40028
tccgaccaacgctaccgccgataaaaacttccgacaacaaaatcgttctatcgcctataaacaaacttaataccataacgccaaccacaatactacttacgttcgaccatcccatcatccataaccataaaaacatccgatcatcctacattcaaatacaaaccacgacgaaatacatcaaaaaaaatctcgctcaaacacttatccactactatcctttcgccgaccgcatttcctacgacgacgacgacgacgatttttacatcgactacaccgacgaaaaactcgaaacgacgttcgcgtatcatcgacaaccaacccactaacgccgaaacgacgataatacaacaactcgccttcaactacacgcccgacgacgaccacctacctcactatctactataaatacaaatcaccacgctatcctacgaaaacttcgtcgtcgaaataacataaaaccataccgtaactaataatttcgacataacacaattcatacaaaccgtcgacgaactcgcccgtaacctaccatcgacgccgtccgtcaccccaatcaaattaaataaccaaaacaacgccgtttctcccttcaccataaccttcatacaattaacaaacaaacacaaaatacc

SEQ ID NO: 40029 - DNA, 708 bp, Artificial Sequence
  chemically treated genomic DNA (Homo sapiens) CpG-island No: 40029
gcggtgggggcgcggttcggcgtcgtgggtcggttcggtagtgtgggggcgcggcggcggtgtggcggtagcggcgttgtttcgcggtggcggcgtttcgtagtagtgggggcgcggttcggcggcgtgggggtttagcggcgtgggggcgcggcggcggcggggtcgtttcgcggtggcggtatttcgcggtggtaggggcgcggttcggcggtgtgggggtttagcggcgtgggggcgcggcggcggcgtgtcgtggcggcggtatgggggttcggcggcgtgggggcgcggcggcggcgtgttacggcggcggtatggggggcgtaacggagcggttcggcggcgtacgtcggcgtcggcgtcgtcggcggtggcggtcgcgtcgaagttattcgtcggtaaaagagagagagttatatcgagagagagagagggtaggggtttttatttaagagacgtggtggcggcgtttgcggtggaggcggcgaggatcgttaggcgatggtgagagacgatggcggcgtcggtgcggggttgttttaggtagtggcggcgaaggagaagtcgatgttcgatttcgatggaaaaacgtttaagtgttggtggagaagacgagggtgtatcgggaatatatatatttttcggatttttattttcggttggtgagaagaatcgggagtaaagattcgtaataataatcgggat

SEQ ID NO: 40030 - DNA, 708 bp, Artificial Sequence
  chemically treated genomic DNA (Homo sapiens) CpG-island No: 40030
atcccgattattattacgaatctttactcccgattcttctcaccaaccgaaaataaaaatccgaaaaatatatatattcccgatacaccctcgtcttctccaccaacacttaaacgtttttccatcgaaatcgaacatcgacttctccttcgccgccactacctaaaacaaccccgcaccgacgccgccatcgtctctcaccatcgcctaacgatcctcgccgcctccaccgcaaacgccgccaccacgtctcttaaataaaaacccctaccctctctctctctcgatataactctctctcttttaccgacgaataacttcgacgcgaccgccaccgccgacgacgccgacgccgacgtacgccgccgaaccgctccgttacgccccccataccgccgccgtaacacgccgccgccgcgcccccacgccgccgaacccccataccgccgccacgacacgccgccgccgcgcccccacgccgctaaacccccacaccgccgaaccgcgcccctaccaccgcgaaataccgccaccgcgaaacgaccccgccgccgccgcgcccccacgccgctaaacccccacgccgccgaaccgcgcccccactactacgaaacgccgccaccgcgaaacaacgccgctaccgccacaccgccgccgcgcccccacactaccgaaccgacccacgacgccgaaccgcgcccccaccgc

SEQ ID NO: 40031 - DNA, 708 bp, Artificial Sequence
  chemically treated genomic DNA (Homo sapiens) CpG-island No: 40031
atttcggttgttgttacgaatttttattttcggttttttttattaatcgggagtaaagattcggggggtatatatattttcggtgtattttcgttttttttattaatatttagacgtttttttatcgagatcgagtatcggtttttttttcgtcgttattgtttagggtaatttcgtatcgacgtcgttatcgttttttattatcgtttggcggttttcgtcgtttttatcgtagacgtcgttattacgttttttgggtaagagtttttgttttttttttttttcgatgtagtttttttttttttgtcgacgaatgatttcggcgcggtcgttatcgtcgacgacgtcgacgtcgacgtacgtcgtcgggtcgtttcgttacgttttttatgtcgtcgtcgtggtacgtcgtcgtcgcgtttttacgtcgtcgggtttttatgtcgtcgttacggtacgtcgtcgtcgcgtttttacgtcgttgggtttttatatcgtcggatcgcgtttttattatcgcgagatgtcgttatcgcgagacgatttcgtcgtcgtcgcgtttttacgtcgttgggtttttacgtcgtcggatcgcgtttttattgttgcgagacgtcgttatcgcgagataacgtcgttgtcgttatatcgtcgtcgcgtttttatattgtcgggtcggtttacggcgtcggatcgcgtttttatcgt

SEQ ID NO: 40032 - DNA, 708 bp, Artificial Sequence
  chemically treated genomic DNA (Homo sapiens) CpG-island No: 40032
acgataaaaacgcgatccgacgccgtaaaccgacccgacaatataaaaacgcgacgacgatataacgacaacgacgttatctcgcgataacgacgtctcgcaacaataaaaacgcgatccgacgacgtaaaaacccaacgacgtaaaaacgcgacgacgacgaaatcgtctcgcgataacgacatctcgcgataataaaaacgcgatccgacgatataaaaacccaacgacgtaaaaacgcgacgacgacgtaccgtaacgacgacataaaaacccgacgacgtaaaaacgcgacgacgacgtaccacgacgacgacataaaaaacgtaacgaaacgacccgacgacgtacgtcgacgtcgacgtcgtcgacgataacgaccgcgccgaaatcattcgtcgacaaaaaaaaaaaaactacatcgaaaaaaaaaaaaaacaaaaactcttacccaaaaaacgtaataacgacgtctacgataaaaacgacgaaaaccgccaaacgataataaaaaacgataacgacgtcgatacgaaattaccctaaacaataacgacgaaaaaaaaaccgatactcgatctcgataaaaaaacgtctaaatattaataaaaaaaacgaaaatacaccgaaaatatatataccccccgaatctttactcccgattaataaaaaaaaccgaaaataaaaattcgtaacaacaaccgaaat

SEQ ID NO: 40033 - DNA, 1446 bp, Artificial Sequence
  chemically treated genomic DNA (Homo sapiens) CpG-island No: 40033
tcgggtatatagagacggtttacgggtcgatagaagtagatttcgtgtgttaatcgaggcgagtggtcgataaacggattttattagatattatacgggttgtatatttggaaattacgcggttatcgagcggatatattattacggttattatacgtataagcgaacgattatcgatatcggtatacgggtatcggggtcgataatcgtataacgggtacggggcgatataaaaagaatgaggacggggtagcgaaggagagatttttattattacgcgacgaggcgagggaacgataacgacgaacgggcgcggcggagacggtcgggaacgacggagacgaaaggcgaggggacgatttcggcggtgatttttggacgaaggcgagacgcggtcggcgtaacgtttggcgacgcggaggcgaggacgaagacgatgacggggttgcggtatttgacggagcgaggacgacgaacgagaacggtttgacggagggacgaacgttacgacgatcgggaacgacgggaggattacgacgacgatgatcggggttggtaaggaggcgacgtgggtagtcggtagcggttgtacggagacgaggacggagtggaatacgtcgttgtgatgtcgacgacggaggcggtgtcgcgagacgacgagtcggcgaggaggaatgatcgatcggaggagtcgtcgacgaggacgaacggagatgacgataacgaatatcggcggggtttagatggaggggaggcgaggtcgagggtaattttgacgttgtgatgtcggaggtggtggttgcgcggtcgacggcgtacgggtggaggaagggtcgattggggaaatttcggtaaggcggatggagaggtcggcgcggtacggcggtgtttcggcgaaatcgagggtaggtcggggtggagggtgacgtcgtaatgtcgacgaaggatacggcgacgtcggtcgacgttcgggcgcggcgatcggggcgattgaaggcggtatagtggcggtaacgttattgttttgttggcgaggacgcgtttttaggggttttcgcgcgaaacggagggtaggtcgggggagaggaggttgttgtgacgacggggaaggtaacggtatagtcggtcggcgcgttgacgcggcggtaggggcggttggaggcggtcggcgcgggggaaagagaagggcgatcgcggggaggggtgatacgattacggtgaggttcgggatgaggttaaaacgatagaatggaggatggggattttattttatagcggagggaagcgagtcgagtacgggaggagcggggaaaggcggcggaaaaggcgttcggcggttatggaaggcggttatgaatggcgtagtcgtttcggttaaaatagtgtacgattaaaggggagattaggggaaatagggagaggaaggaaaggggattaatttttttt

SEQ ID NO: 40034 - DNA, 1446 bp, Artificial Sequence
  chemically treated genomic DNA (Homo sapiens) CpG-island No: 40034
aaaaaaaattaatcccctttccttcctctccctatttcccctaatctcccctttaatcgtacactattttaaccgaaacgactacgccattcataaccgccttccataaccgccgaacgccttttccgccgcctttccccgctcctcccgtactcgactcgcttccctccgctataaaataaaatccccatcctccattctatcgttttaacctcatcccgaacctcaccgtaatcgtatcacccctccccgcgatcgcccttctctttcccccgcgccgaccgcctccaaccgcccctaccgccgcgtcaacgcgccgaccgactataccgttaccttccccgtcgtcacaacaacctcctctcccccgacctaccctccgtttcgcgcgaaaacccctaaaaacgcgtcctcgccaacaaaacaataacgttaccgccactataccgccttcaatcgccccgatcgccgcgcccgaacgtcgaccgacgtcgccgtatccttcgtcgacattacgacgtcaccctccaccccgacctaccctcgatttcgccgaaacaccgccgtaccgcgccgacctctccatccgccttaccgaaatttccccaatcgacccttcctccacccgtacgccgtcgaccgcgcaaccaccacctccgacatcacaacgtcaaaattaccctcgacctcgcctcccctccatctaaaccccgccgatattcgttatcgtcatctccgttcgtcctcgtcgacgactcctccgatcgatcattcctcctcgccgactcgtcgtctcgcgacaccgcctccgtcgtcgacatcacaacgacgtattccactccgtcctcgtctccgtacaaccgctaccgactacccacgtcgcctccttaccaaccccgatcatcgtcgtcgtaatcctcccgtcgttcccgatcgtcgtaacgttcgtccctccgtcaaaccgttctcgttcgtcgtcctcgctccgtcaaataccgcaaccccgtcatcgtcttcgtcctcgcctccgcgtcgccaaacgttacgccgaccgcgtctcgccttcgtccaaaaatcaccgccgaaatcgtcccctcgcctttcgtctccgtcgttcccgaccgtctccgccgcgcccgttcgtcgttatcgttccctcgcctcgtcgcgtaataataaaaatctctccttcgctaccccgtcctcattctttttatatcgccccgtacccgttatacgattatcgaccccgatacccgtataccgatatcgataatcgttcgcttatacgtataataaccgtaataatatatccgctcgataaccgcgtaatttccaaatatacaacccgtataatatctaataaaatccgtttatcgaccactcgcctcgattaacacacgaaatctacttctatcgacccgtaaaccgtctctatatacccga

SEQ ID NO: 40035 - DNA, 1446 bp, Artificial Sequence
  chemically treated genomic DNA (Homo sapiens) CpG-island No: 40035
ggggggaattaatttttttttttttttttttttattttttttaattttttttttgatcgtgtattattttgatcggaacggttgcgttatttatggtcgttttttatggtcgtcgggcgtttttttcgtcgttttttttcgtttttttcgtgttcggttcgttttttttcgttataaaatggaatttttattttttattttatcgttttagttttatttcgagttttatcgtggtcgtattattttttttcgcggtcgtttttttttttttttcgcgtcggtcgtttttagtcgtttttgtcgtcgcgttagcgcgtcggtcggttgtgtcgttgtttttttcgtcgttatagtagttttttttttttcggtttgtttttcgtttcgcgcggagatttttggagacgcgttttcgttagtaaaatagtggcgttgtcgttattgtatcgtttttagtcgtttcgatcgtcgcgttcgagcgtcggtcgacgtcgtcgtatttttcgtcgatattgcggcgttattttttatttcggtttgttttcggtttcgtcggaatatcgtcgtgtcgcgtcggtttttttattcgttttgtcggaatttttttagtcggttttttttttattcgtgcgtcgtcggtcgcgtaattattattttcggtattatagcgttaaggttgttttcggtttcgttttttttttatttgaatttcgtcggtgttcgttatcgttattttcgttcgttttcgtcgacgattttttcggtcggttattttttttcgtcgattcgtcgtttcgcggtatcgttttcgtcgtcggtattatagcggcgtgttttatttcgttttcgttttcgtgtagtcgttgtcggttgtttacgtcgtttttttgttagtttcggttatcgtcgtcgtagttttttcgtcgttttcggtcgtcgtggcgttcgttttttcgttaagtcgttttcgttcgtcgttttcgtttcgttaagtgtcgtagtttcgttatcgttttcgttttcgttttcgcgtcgttaagcgttacgtcggtcgcgtttcgttttcgtttaaggattatcgtcgaagtcgttttttcgtttttcgttttcgtcgttttcggtcgttttcgtcgcgttcgttcgtcgttgtcgttttttcgtttcgtcgcgtggtggtaaggatttttttttcgttgtttcgtttttattttttttgtgtcgtttcgtgttcgttgtgcggttgtcgatttcggtattcgtgtatcggtgtcggtagtcgttcgtttgtgcgtgtggtgatcgtgatagtgtgttcgttcggtagtcgcgtggtttttaagtgtgtagttcgtgtggtgtttagtggagttcgtttgtcggttattcgtttcggttgatatacgggatttgtttttgtcgattcgtggatcgtttttgtgtattcgg

SEQ ID NO: 40036 - DNA, 1446 bp, Artificial Sequence
  chemically treated genomic DNA (Homo sapiens) CpG-island No: 40036
ccgaatacacaaaaacgatccacgaatcgacaaaaacaaatcccgtatatcaaccgaaacgaataaccgacaaacgaactccactaaacaccacacgaactacacacttaaaaaccacgcgactaccgaacgaacacactatcacgatcaccacacgcacaaacgaacgactaccgacaccgatacacgaataccgaaatcgacaaccgcacaacgaacacgaaacgacacaaaaaaaataaaaacgaaacaacgaaaaaaaaatccttaccaccacgcgacgaaacgaaaaaacgacaacgacgaacgaacgcgacgaaaacgaccgaaaacgacgaaaacgaaaaacgaaaaaacgacttcgacgataatccttaaacgaaaacgaaacgcgaccgacgtaacgcttaacgacgcgaaaacgaaaacgaaaacgataacgaaactacgacacttaacgaaacgaaaacgacgaacgaaaacgacttaacgaaaaaacgaacgccacgacgaccgaaaacgacgaaaaaactacgacgacgataaccgaaactaacaaaaaaacgacgtaaacaaccgacaacgactacacgaaaacgaaaacgaaataaaacacgccgctataataccgacgacgaaaacgataccgcgaaacgacgaatcgacgaaaaaaaataaccgaccgaaaaaatcgtcgacgaaaacgaacgaaaataacgataacgaacaccgacgaaattcaaataaaaaaaaaacgaaaccgaaaacaaccttaacgctataataccgaaaataataattacgcgaccgacgacgcacgaataaaaaaaaaaccgactaaaaaaattccgacaaaacgaataaaaaaaccgacgcgacacgacgatattccgacgaaaccgaaaacaaaccgaaataaaaaataacgccgcaatatcgacgaaaaatacgacgacgtcgaccgacgctcgaacgcgacgatcgaaacgactaaaaacgatacaataacgacaacgccactattttactaacgaaaacgcgtctccaaaaatctccgcgcgaaacgaaaaacaaaccgaaaaaaaaaaaactactataacgacgaaaaaaacaacgacacaaccgaccgacgcgctaacgcgacgacaaaaacgactaaaaacgaccgacgcgaaaaaaaaaaaaaaacgaccgcgaaaaaaaataatacgaccacgataaaactcgaaataaaactaaaacgataaaataaaaaataaaaattccattttataacgaaaaaaaacgaaccgaacacgaaaaaaacgaaaaaaaacgacgaaaaaaacgcccgacgaccataaaaaacgaccataaataacgcaaccgttccgatcaaaataatacacgatcaaaaaaaaaattaaaaaaaataaaaaaaaaaaaaaaaaaaaattaattcccccc

SEQ ID NO: 40037 - DNA, 549 bp, Artificial Sequence
  chemically treated genomic DNA (Homo sapiens) CpG-island No: 40037
cgaagcggtcgacgatgggcgtcgtcgtttcggtcgttttcggcgtcgatttgagtttttggttcgattggaggaagtcgcggttgatttcgatgttggtgtagtagtggttgtcgaaggtgttcggcgtcgtcgggtttaggtcgttgagcgtcgtcggcggttcgttgggcgggtatcgttgcgataggaagtttcggtaggcggcgtttatggtggggttcggttttttcgtgttgttgaagttgtatagtttgttcgttacgaattggtattgtattttttcgaacgtgtgtttatttgtatttcgtattattgtcgtcgtcgttagtttcggcgggtatgacggtagaattgaaattgagttcgtcggagaagtgatacgagtatttgagagggcgacgaggtcgacgtcgttgaggttgagggcggcgaatttttggcggaggacggtgaggttgtcggtgggggtcggtaggttgagggagttattgaagtcggaggttttgtcgtcgagtcgttttagtagtattttttattcgggtttat

SEQ ID NO: 40038 - DNA, 549 bp, Artificial Sequence
  chemically treated genomic DNA (Homo sapiens) CpG-island No: 40038
ataaacccgaataaaaaatactactaaaacgactcgacgacaaaacctccgacttcaataactccctcaacctaccgacccccaccgacaacctcaccgtcctccgccaaaaattcgccgccctcaacctcaacgacgtcgacctcgtcgccctctcaaatactcgtatcacttctccgacgaactcaatttcaattctaccgtcatacccgccgaaactaacgacgacgacaataatacgaaatacaaataaacacacgttcgaaaaaatacaataccaattcgtaacgaacaaactatacaacttcaacaacacgaaaaaaccgaaccccaccataaacgccgcctaccgaaacttcctatcgcaacgatacccgcccaacgaaccgccgacgacgctcaacgacctaaacccgacgacgccgaacaccttcgacaaccactactacaccaacatcgaaatcaaccgcgacttcctccaatcgaaccaaaaactcaaatcgacgccgaaaacgaccgaaacgacgacgcccatcgtcgaccgcttcg

SEQ ID NO: 40039 - DNA, 549 bp, Artificial Sequence
  chemically treated genomic DNA (Homo sapiens) CpG-island No: 40039
gtgggttcgggtggggagtgttgttggggcggttcgacggtaagattttcgattttaatggtttttttaatttgtcggtttttatcgataattttatcgtttttcgttaaaagttcgtcgtttttaattttaacgacgtcgatttcgtcgtttttttaggtattcgtattattttttcggcgaatttaattttagttttgtcgttatgttcgtcggagttgacgacgacgataataatgcgaaatgtaggtgggtatacgttcgggagggtgtagtgttagttcgtgacggataggttgtataattttagtaatacggggaggtcggattttattatggacgtcgtttatcggagttttttgtcgtagcggtgttcgtttaacgggtcgtcggcggcgtttaacgatttggattcgacgacgtcggatattttcgataattattattatattaatatcgaggttaatcgcggttttttttagtcggattaggagtttaagtcggcgtcggaggcgatcgggacgacggcgtttatcgtcgatcgtttcg

SEQ ID NO: 40040 - DNA, 549 bp, Artificial Sequence
  chemically treated genomic DNA (Homo sapiens) CpG-island No: 40040
cgaaacgatcgacgataaacgccgtcgtcccgatcgcctccgacgccgacttaaactcctaatccgactaaaaaaaaccgcgattaacctcgatattaatataataataattatcgaaaatatccgacgtcgtcgaatccaaatcgttaaacgccgccgacgacccgttaaacgaacaccgctacgacaaaaaactccgataaacgacgtccataataaaatccgacctccccgtattactaaaattatacaacctatccgtcacgaactaacactacaccctcccgaacgtatacccacctacatttcgcattattatcgtcgtcgtcaactccgacgaacataacgacaaaactaaaattaaattcgccgaaaaaataatacgaatacctaaaaaaacgacgaaatcgacgtcgttaaaattaaaaacgacgaacttttaacgaaaaacgataaaattatcgataaaaaccgacaaattaaaaaaaccattaaaatcgaaaatcttaccgtcgaaccgccccaacaacactccccacccgaacccac

SEQ ID NO: 40041 - DNA, 716 bp, Artificial Sequence
  chemically treated genomic DNA (Homo sapiens) CpG-island No: 40041
gttatttggggcggcgacggcgatcgagtaaggggaggaggcggcggtttattaacggcggtggcggcgacggcggcgcgacgacgtcgtacggcgtacggtgcggcggtacgaaggcggcggtgcggcggcgcgagggcggcgcgacggcgacggcggcgtaagacggcgacgtacggcgcggcggtttcggggcgacggcgcggcggtttcgaaggtggcggcgcggcggtacgataacggcggcgcggggtacgaggcggcgacgggacgcgcggcgatcggacgttgacggcggcggcgatagcggcggcgcgcggttcggggcgggacgcgacgggcggcgacgcgacggtagcgcggcgcgacggcgacggggcgagatgattggcgagcggcgatgggacgggcggacggttcggggcgcgaggtagcgcggtacggggcgcgtcgcggggcgacggggcggcgcgcggcgtagggcgtaaggtcggttagggcggcgtagtagcgatggcgacggcgataggcggcgatggcgacgtcggcgcggcggtaggcgacggcgcgacgggacggtgacggcgacggcgcggtagcggcggtgcggggtttagggaatggtcgggcgcgtggtagagaagggtttagggttagggattaaaatcgaatatttatgaggtaatgaatagtgattttttttatttatttcgatt

SEQ ID NO: 40042 - DNA, 716 bp, Artificial Sequence
  chemically treated genomic DNA (Homo sapiens) CpG-island No: 40042
aatcgaaataaataaaaaaaatcactattcattacctcataaatattcgattttaatccctaaccctaaacccttctctaccacgcgcccgaccattccctaaaccccgcaccgccgctaccgcgccgtcgccgtcaccgtcccgtcgcgccgtcgcctaccgccgcgccgacgtcgccatcgccgcctatcgccgtcgccatcgctactacgccgccctaaccgaccttacgccctacgccgcgcgccgccccgtcgccccgcgacgcgccccgtaccgcgctacctcgcgccccgaaccgtccgcccgtcccatcgccgctcgccaatcatctcgccccgtcgccgtcgcgccgcgctaccgtcgcgtcgccgcccgtcgcgtcccgccccgaaccgcgcgccgccgctatcgccgccgccgtcaacgtccgatcgccgcgcgtcccgtcgccgcctcgtaccccgcgccgccgttatcgtaccgccgcgccgccaccttcgaaaccgccgcgccgtcgccccgaaaccgccgcgccgtacgtcgccgtcttacgccgccgtcgccgtcgcgccgccctcgcgccgccgcaccgccgccttcgtaccgccgcaccgtacgccgtacgacgtcgtcgcgccgccgtcgccgccaccgccgttaataaaccgccgcctcctccccttactcgatcgccgtcgccgccccaaataac

SEQ ID NO: 40043 - DNA, 716 bp, Artificial Sequence
  chemically treated genomic DNA (Homo sapiens) CpG-island No: 40043
aatcgggataaataggaaaagttattgtttattgttttataggtgttcgattttggtttttagttttagatttttttttgttacgcgttcggttattttttgagtttcgtatcgtcgttatcgcgtcgtcgtcgttatcgtttcgtcgcgtcgtcgtttgtcgtcgcgtcgacgtcgttatcgtcgtttgtcgtcgtcgttatcgttgttgcgtcgttttagtcggttttgcgttttgcgtcgcgcgtcgtttcgtcgtttcgcgacgcgtttcgtatcgcgttgtttcgcgtttcgagtcgttcgttcgttttatcgtcgttcgttagttatttcgtttcgtcgtcgtcgcgtcgcgttatcgtcgcgtcgtcgttcgtcgcgtttcgtttcgagtcgcgcgtcgtcgttgtcgtcgtcgtcgttaacgttcggtcgtcgcgcgtttcgtcgtcgtttcgtgtttcgcgtcgtcgttgtcgtgtcgtcgcgtcgttattttcgaagtcgtcgcgtcgtcgtttcggagtcgtcgcgtcgtgcgtcgtcgttttgcgtcgtcgtcgtcgtcgcgtcgttttcgcgtcgtcgtatcgtcgttttcgtgtcgtcgtatcgtgcgtcgtgcgacgtcgtcgcgtcgtcgtcgtcgttatcgtcgttggtaagtcgtcgttttttttttttgttcggtcgtcgtcgtcgttttaggtagt

SEQ ID NO: 40044 - DNA, 716 bp, Artificial Sequence
  chemically treated genomic DNA (Homo sapiens) CpG-island No: 40044
actacctaaaacgacgacgacgaccgaacaaaaaaaaaaaacgacgacttaccaacgacgataacgacgacgacgacgcgacgacgtcgcacgacgcacgatacgacgacacgaaaacgacgatacgacgacgcgaaaacgacgcgacgacgacgacgacgcaaaacgacgacgcacgacgcgacgactccgaaacgacgacgcgacgacttcgaaaataacgacgcgacgacacgacaacgacgacgcgaaacacgaaacgacgacgaaacgcgcgacgaccgaacgttaacgacgacgacgacaacgacgacgcgcgactcgaaacgaaacgcgacgaacgacgacgcgacgataacgcgacgcgacgacgacgaaacgaaataactaacgaacgacgataaaacgaacgaacgactcgaaacgcgaaacaacgcgatacgaaacgcgtcgcgaaacgacgaaacgacgcgcgacgcaaaacgcaaaaccgactaaaacgacgcaacaacgataacgacgacgacaaacgacgataacgacgtcgacgcgacgacaaacgacgacgcgacgaaacgataacgacgacgacgcgataacgacgatacgaaactcaaaaaataaccgaacgcgtaacaaaaaaaaatctaaaactaaaaaccaaaatcgaacacctataaaacaataaacaataacttttcctatttatcccgatt

SEQ ID NO: 40045 - DNA, 1264 bp, Artificial Sequence
  chemically treated genomic DNA (Homo sapiens) CpG-island No: 40045
agcggtcgaggtggtcgtcgtcgatgtcgtcggcgatttatttcggcgagtcgtttttcgcggtggtatgggatacgacggtgacgacgacggagttgaggtagttgtcgagcgagtacgttatgtggtcgagcgtcgagtagaggttttttatggagttcggcgtttggttgtagaagaattttagttgttcgatgtgggttaatatcgcgttggcgtcgagtagtacgtattgcggtatttgttacgcgatgtttatttcgtcggcggtcgttagtcgtttgttttcgacggtcgtcgcggcggttatggcggcgacggatagcgttatgtcggcgtcgatgcgttgtagttcggttagttttttttcgttgtcggtgagtcgtcgcgtcgcgggtattatcgcggcgtcgtagagcggtacgaggacgagtatggtagcggcgtagacggagttgagcgacgtcgtcgggacggcgaacgcgatttcgaggcggcggcgtatggcgcggttttgtatcgggaagagcggttgttggacgagtattatgtagtagacgatttcggtggtttatatcggtagtattcgtacgatcgtttttagtttttttatttgcgttatcgtgtatagtttttacggttgcgtcgtcgtcgacgacggtatcgttatcgttatcgtcgttttgtttaagaaattgaattggtcggtgtgcgttatttttcgttttttttttgtcggattatcgtagaggacgaagtcgtcgtgaggtagtacgacgtttttttttttgacggcggcgacgacgatttggtaagttcggattatttggttgttacgaggttggtggtatttgtatatggcggagtcgaggaggaagttggttatggcgaggacggtgtagagggtcgggacgtcgaagtcgaggagttagtcgaagttgttttgtagttatattacggcggagtcggagacgagggcgtcgacgtatatggcgaagtagaattagttgaagtaggagttttttttgggtttttttatggcgtcgtcgtcgtcgaattggtcggcgtcgaatggttttacgtaggatttgatgtagtcggcgtcgatggttatgaggtatagttttagggagaagacggtcggttgggtgtttcggttgatgatcgtcggcgacgttttcgatagcgttatcgtttttattttttgtaattagtgtatcgatgatcgattataagagaagattttaaattcgtttgaaatttg

SEQ ID NO: 40046 - DNA, 1264 bp, Artificial Sequence
  chemically treated genomic DNA (Homo sapiens) CpG-island No: 40046
caaatttcaaacgaatttaaaatcttctcttataatcgatcatcgatacactaattacaaaaaataaaaacgataacgctatcgaaaacgtcgccgacgatcatcaaccgaaacacccaaccgaccgtcttctccctaaaactatacctcataaccatcgacgccgactacatcaaatcctacgtaaaaccattcgacgccgaccaattcgacgacgacgacgccataaaaaaacccaaaaaaaactcctacttcaactaattctacttcgccatatacgtcgacgccctcgtctccgactccgccgtaatataactacaaaacaacttcgactaactcctcgacttcgacgtcccgaccctctacaccgtcctcgccataaccaacttcctcctcgactccgccatatacaaataccaccaacctcgtaacaaccaaataatccgaacttaccaaatcgtcgtcgccgccgtcaaaaaaaaaaacgtcgtactacctcacgacgacttcgtcctctacgataatccgacaaaaaaaaaacgaaaaataacgcacaccgaccaattcaatttcttaaacaaaacgacgataacgataacgataccgtcgtcgacgacgacgcaaccgtaaaaactatacacgataacgcaaataaaaaaactaaaaacgatcgtacgaatactaccgatataaaccaccgaaatcgtctactacataatactcgtccaacaaccgctcttcccgatacaaaaccgcgccatacgccgccgcctcgaaatcgcgttcgccgtcccgacgacgtcgctcaactccgtctacgccgctaccatactcgtcctcgtaccgctctacgacgccgcgataatacccgcgacgcgacgactcaccgacaacgaaaaaaaactaaccgaactacaacgcatcgacgccgacataacgctatccgtcgccgccataaccgccgcgacgaccgtcgaaaacaaacgactaacgaccgccgacgaaataaacatcgcgtaacaaataccgcaatacgtactactcgacgccaacgcgatattaacccacatcgaacaactaaaattcttctacaaccaaacgccgaactccataaaaaacctctactcgacgctcgaccacataacgtactcgctcgacaactacctcaactccgtcgtcgtcaccgtcgtatcccataccaccgcgaaaaacgactcgccgaaataaatcgccgacgacatcgacgacgaccacctcgaccgct

SEQ ID NO: 40047 - DNA, 1264 bp, Artificial Sequence
  chemically treated genomic DNA (Homo sapiens) CpG-island No: 40047
taaattttaaacgaatttgaaatttttttttgtgatcgattatcgatgtattgattgtaggggatgggaacgatggcgttgtcgggggcgtcgtcggcggttattagtcggagtatttagtcggtcgttttttttttggggttgtattttatggttatcggcgtcggttgtattaagttttgcgtggggttattcggcgtcgattagttcgacggcggcgacgttatggagaggtttaagaagagtttttattttaattggttttatttcgttatgtacgtcggcgttttcgttttcggtttcgtcgtggtgtggttgtaggataatttcggttggtttttcggtttcggcgtttcggttttttgtatcgttttcgttatggttagtttttttttcggtttcgttatgtataggtattattagtttcgtggtagttaggtggttcgagtttgttaggtcgtcgtcgtcgtcgttaggaagaggaacgtcgtgttgttttacgacggtttcgttttttacgatggttcggtagaggaggggcggaggatggcgtatatcgattagtttagttttttggataaggcggcggtggcggtggcggtgtcgtcgtcggcggcggcgtagtcgtggaggttgtgtacggtgacgtaggtggaggagttgaaggcgatcgtgcggatgttgtcggtgtgggttatcgggatcgtttattgtatggtgttcgtttagtagtcgtttttttcggtgtagggtcgcgttatgcgtcgtcgtttcggggtcgcgttcgtcgtttcggcggcgtcgtttaatttcgtttacgtcgttgttatgttcgttttcgtgtcgttttacgacgtcgcggtggtgttcgcggcgcggcggtttatcggtagcgagagggggttgatcgagttgtagcgtatcggcgtcggtatggcgttattcgtcgtcgttatggtcgtcgcggcgatcgtcgagggtaggcgattggcggtcgtcggcgaggtgagtatcgcgtggtaggtgtcgtaatacgtgttgttcggcgttagcgcggtgttggtttatatcgggtagttggagtttttttataattaggcgtcggattttatgaggagtttttgttcggcgttcggttatatgacgtgttcgttcggtagttattttagtttcgtcgtcgttatcgtcgtgttttatgttatcgcgaggggcggttcgtcggggtggatcgtcgacgatatcgacgacggttatttcgatcgtt

SEQ ID NO: 40048 - DNA, 1264 bp, Artificial Sequence
  chemically treated genomic DNA (Homo sapiens) CpG-island No: 40048
aacgatcgaaataaccgtcgtcgatatcgtcgacgatccaccccgacgaaccgcccctcgcgataacataaaacacgacgataacgacgacgaaactaaaataactaccgaacgaacacgtcatataaccgaacgccgaacaaaaactcctcataaaatccgacgcctaattataaaaaaactccaactacccgatataaaccaacaccgcgctaacgccgaacaacacgtattacgacacctaccacgcgatactcacctcgccgacgaccgccaatcgcctaccctcgacgatcgccgcgacgaccataacgacgacgaataacgccataccgacgccgatacgctacaactcgatcaaccccctctcgctaccgataaaccgccgcgccgcgaacaccaccgcgacgtcgtaaaacgacacgaaaacgaacataacaacgacgtaaacgaaattaaacgacgccgccgaaacgacgaacgcgaccccgaaacgacgacgcataacgcgaccctacaccgaaaaaaacgactactaaacgaacaccatacaataaacgatcccgataacccacaccgacaacatccgcacgatcgccttcaactcctccacctacgtcaccgtacacaacctccacgactacgccgccgccgacgacgacaccgccaccgccaccgccgccttatccaaaaaactaaactaatcgatatacgccatcctccgcccctcctctaccgaaccatcgtaaaaaacgaaaccgtcgtaaaacaacacgacgttcctcttcctaacgacgacgacgacgacctaacaaactcgaaccacctaactaccacgaaactaataatacctatacataacgaaaccgaaaaaaaaactaaccataacgaaaacgatacaaaaaaccgaaacgccgaaaccgaaaaaccaaccgaaattatcctacaaccacaccacgacgaaaccgaaaacgaaaacgccgacgtacataacgaaataaaaccaattaaaataaaaactcttcttaaacctctccataacgtcgccgccgtcgaactaatcgacgccgaataaccccacgcaaaacttaatacaaccgacgccgataaccataaaatacaaccccaaaaaaaaaacgaccgactaaatactccgactaataaccgccgacgacgcccccgacaacgccatcgttcccatcccctacaatcaatacatcgataatcgatcacaaaaaaaaatttcaaattcgtttaaaattta

SEQ ID NO: 40049 - DNA, 742 bp, Artificial Sequence
  chemically treated genomic DNA (Homo sapiens) CpG-island No: 40049
tcgttattaattagaagaatcgatcgagatgtttttcgtttagatttttcgggatttattcgttatggtcgtcgtcgtcgtcggtgacggagttgatgatggtgagtatggcggagaggaggtagttttcgggggtgattatgatgagcgagtacgtttggtataagttttttatggcgtcggggttttgttcgtacgcgaattcgatgtatttaacgacgtcgaatattttcgttatttcgacgagtacgtattgcggcgtttgttataggatgtttatcgtcggagtattcgtttttacgttgcggaggcgcgtcgttttaacggtcgcggcggcggcgagcgcgagaacggcgaagattatttcgacgtcgatgcggtgtagttcggagaggtcgcgtttgacgtcggtgagtttgtttatcgtcggtatgaggattttgtcgtatgtcggcgcgaggacgaggatgtagacgtaggtgaaggtcgttagcgacgtcggtggtaaggcgaaggcggcggcgacgtggttgtttatggcgtttttttgttcgacgaatagcgggaagtaggtttcggcggtgttgaagattatttcggtgaggaagatggggagtattttcgtaaagattttgagtttttttatttgcgttatcgtgtatagtttttatggacgattagttgatgttttatcggatgtagtgatagtggtagttcggttaaagaatttaattgtaataat

SEQ ID NO: 40050 - DNA, 742 bp, Artificial Sequence
  chemically treated genomic DNA (Homo sapiens) CpG-island No: 40050
attattacaattaaattctttaaccgaactaccactatcactacatccgataaaacatcaactaatcgtccataaaaactatacacgataacgcaaataaaaaaactcaaaatctttacgaaaatactccccatcttcctcaccgaaataatcttcaacaccgccgaaacctacttcccgctattcgtcgaacaaaaaaacgccataaacaaccacgtcgccgccgccttcgccttaccaccgacgtcgctaacgaccttcacctacgtctacatcctcgtcctcgcgccgacatacgacaaaatcctcataccgacgataaacaaactcaccgacgtcaaacgcgacctctccgaactacaccgcatcgacgtcgaaataatcttcgccgttctcgcgctcgccgccgccgcgaccgttaaaacgacgcgcctccgcaacgtaaaaacgaatactccgacgataaacatcctataacaaacgccgcaatacgtactcgtcgaaataacgaaaatattcgacgtcgttaaatacatcgaattcgcgtacgaacaaaaccccgacgccataaaaaacttataccaaacgtactcgctcatcataatcacccccgaaaactacctcctctccgccatactcaccatcatcaactccgtcaccgacgacgacgacgaccataacgaataaatcccgaaaaatctaaacgaaaaacatctcgatcgattcttctaattaataacga

SEQ ID NO: 40051 - DNA, 742 bp, Artificial Sequence
  chemically treated genomic DNA (Homo sapiens) CpG-island No: 40051
attgttgtaattaggttttttgatcgagttgttattattattgtattcgatgaagtattagttagtcgtttatggaagttgtgtacggtgacgtaggtggaggagtttaagatttttgcgaggatgttttttattttttttatcggagtaatttttaatatcgtcgaggtttgtttttcgttgttcgtcgagtagggaggcgttatggataattacgtcgtcgtcgttttcgttttgttatcggcgtcgttgacgatttttatttgcgtttgtattttcgttttcgcgtcgatatacgatagggtttttatgtcggcggtgagtaggtttatcggcgttaagcgcggttttttcgagttgtatcgtatcggcgtcggaatggttttcgtcgttttcgcgttcgtcgtcgtcgcggtcgttgagacggcgcgttttcgtagcgtggaggcggatgtttcggcggtgagtattttgtggtaggcgtcgtagtacgtgttcgtcggggtggcgaaggtgttcggcgtcgttgggtatatcgagttcgcgtacgagtagagtttcgacgttatgaggagtttgtgttaggcgtgttcgtttattatggttattttcgggagttatttttttttcgttatgtttattattattagtttcgttatcggcggcggcggcggttatggcggatggatttcggagaatttgaacgagggatatttcgatcgatttttttggttgatggcgg

SEQ ID NO: 40052 - DNA, 742 bp, Artificial Sequence
  chemically treated genomic DNA (Homo sapiens) CpG-island No: 40052
ccgccatcaaccaaaaaaatcgatcgaaatatccctcgttcaaattctccgaaatccatccgccataaccgccgccgccgccgataacgaaactaataataataaacataacgaaaaaaaaataactcccgaaaataaccataataaacgaacacgcctaacacaaactcctcataacgtcgaaactctactcgtacgcgaactcgatatacccaacgacgccgaacaccttcgccaccccgacgaacacgtactacgacgcctaccacaaaatactcaccgccgaaacatccgcctccacgctacgaaaacgcgccgtctcaacgaccgcgacgacgacgaacgcgaaaacgacgaaaaccattccgacgccgatacgatacaactcgaaaaaaccgcgcttaacgccgataaacctactcaccgccgacataaaaaccctatcgtatatcgacgcgaaaacgaaaatacaaacgcaaataaaaatcgtcaacgacgccgataacaaaacgaaaacgacgacgacgtaattatccataacgcctccctactcgacgaacaacgaaaaacaaacctcgacgatattaaaaattactccgataaaaaaaataaaaaacatcctcgcaaaaatcttaaactcctccacctacgtcaccgtacacaacttccataaacgactaactaatacttcatcgaatacaataataataacaactcgatcaaaaaacctaattacaacaat

SEQ ID NO: 40053 - DNA, 807 bp, Artificial Sequence
  chemically treated genomic DNA (Homo sapiens) CpG-island No: 40053
ggcggtacgagcgaaggtagcgtaagatgggtttatagtaaattttagtgcgttttttgtagtggtttcgttcgaggtcgtggtcgtgttttggagtcgcgaggtgacgtttagcggttcggttagtaattttatagttggtcgaggttcgtcggttgtcgtttttatttgggaggaattttaggtcgagatggggtatattatcgaggttggtatttacggtattagttacgagattgcggaggcgagggcggcggcggtatcgtcggtaaatgagcgtgtcgatcggttgacgcgtgatttggcggaggttcgcgaggttttttagaagatgagagaattggtggtcggtaacgagcgataattgtaggggttcgagtatcgtatgtcggagttcgagaatgatttgtcggagattcgtggttcgttgtgggttatttatattagtttgtattagtttttcggggagtgcggtgttacgattattatttcggagaatttcgatgagttttcgttgacgatttcgtttacggaattggtaacggcgatggaggcgattttttttaagtacgcggttaggattagagaggagacgtttaacgggatttatatcggggcgtgttacgtttttgcgtgtgtgaggttggtatattttgaatttaatttttagaagattttggattagggggcggttagcgacgcgcgtaaagatgtgatggaagaagtcggcgaattaggggagtttgtttttttattttttgaagagtagggttatcgtttgtttgtattttttaattaatcgcgttt

SEQ ID NO: 40054 - DNA, 807 bp, Artificial Sequence
  chemically treated genomic DNA (Homo sapiens) CpG-island No: 40054
aaacgcgattaattaaaaaatacaaacaaacgataaccctactcttcaaaaaataaaaaaacaaactcccctaattcgccgacttcttccatcacatctttacgcgcgtcgctaaccgccccctaatccaaaatcttctaaaaattaaattcaaaatataccaacctcacacacgcaaaaacgtaacacgccccgatataaatcccgttaaacgtctcctctctaatcctaaccgcgtacttaaaaaaaatcgcctccatcgccgttaccaattccgtaaacgaaatcgtcaacgaaaactcatcgaaattctccgaaataataatcgtaacaccgcactccccgaaaaactaatacaaactaatataaataacccacaacgaaccacgaatctccgacaaatcattctcgaactccgacatacgatactcgaacccctacaattatcgctcgttaccgaccaccaattctctcatcttctaaaaaacctcgcgaacctccgccaaatcacgcgtcaaccgatcgacacgctcatttaccgacgataccgccgccgccctcgcctccgcaatctcgtaactaataccgtaaataccaacctcgataatataccccatctcgacctaaaattcctcccaaataaaaacgacaaccgacgaacctcgaccaactataaaattactaaccgaaccgctaaacgtcacctcgcgactccaaaacacgaccacgacctcgaacgaaaccactacaaaaaacgcactaaaatttactataaacccatcttacgctaccttcgctcgtaccgcc

SEQ ID NO: 40055 - DNA, 807 bp, Artificial Sequence
  chemically treated genomic DNA (Homo sapiens) CpG-island No: 40055
aaacgcgattggttaaggggtatagataagcggtggttttattttttaaaaagtgggaggatagatttttttagttcgtcgattttttttattatatttttgcgcgcgtcgttagtcgttttttgatttaagattttttggagattgagtttagggtgtgttaattttatatacgtaaggacgtggtacgtttcggtgtagatttcgttggacgttttttttttgattttggtcgcgtgtttagaggggatcgtttttatcgtcgttgttagtttcgtgagcgaagtcgttagcgagaatttatcgggatttttcgggatggtggtcgtgatatcgtatttttcggagagttggtgtagattagtgtaggtgatttatagcgagttacggattttcgataagttattttcgagtttcgatatacggtgttcgagtttttgtagttgtcgttcgttgtcggttattagtttttttattttttagaggatttcgcgaattttcgttaaattacgcgttagtcgatcggtacgtttatttgtcgacgatgtcgtcgtcgttttcgttttcgtaatttcgtgattaatgtcgtgagtgttagtttcgatgatgtgttttatttcgatttggagttttttttaggtgaggacggtagtcggcgggtttcgattagttgtgggattgttggtcgggtcgttgggcgttatttcgcggttttaaggtacgattacgatttcggacgaggttattgtaggagacgtattggagtttgttgtagatttattttgcgttgttttcgttcgtgtcgtt

SEQ ID NO: 40056 - DNA, 807 bp, Artificial Sequence
  chemically treated genomic DNA (Homo sapiens) CpG-island No: 40056
aacgacacgaacgaaaacaacgcaaaataaatctacaacaaactccaatacgtctcctacaataacctcgtccgaaatcgtaatcgtaccttaaaaccgcgaaataacgcccaacgacccgaccaacaatcccacaactaatcgaaacccgccgactaccgtcctcacctaaaaaaaactccaaatcgaaataaaacacatcatcgaaactaacactcacgacattaatcacgaaattacgaaaacgaaaacgacgacgacatcgtcgacaaataaacgtaccgatcgactaacgcgtaatttaacgaaaattcgcgaaatcctctaaaaaataaaaaaactaataaccgacaacgaacgacaactacaaaaactcgaacaccgtatatcgaaactcgaaaataacttatcgaaaatccgtaactcgctataaatcacctacactaatctacaccaactctccgaaaaatacgatatcacgaccaccatcccgaaaaatcccgataaattctcgctaacgacttcgctcacgaaactaacaacgacgataaaaacgatcccctctaaacacgcgaccaaaatcaaaaaaaaaacgtccaacgaaatctacaccgaaacgtaccacgtccttacgtatataaaattaacacaccctaaactcaatctccaaaaaatcttaaatcaaaaaacgactaacgacgcgcgcaaaaatataataaaaaaaatcgacgaactaaaaaaatctatcctcccactttttaaaaaataaaaccaccgcttatctataccccttaaccaatcgcgttt

SEQ ID NO: 40057 - DNA, 950 bp, Artificial Sequence
  chemically treated genomic DNA (Homo sapiens) CpG-island No: 40057
tcgggtcggaatttttcgggttatcggatattacgtagagaacggttgaaagttttatatttagcgttagggcggtgggttgtcggcgatcgtgtgtttttcgtgggtgtttatcggatgacgaagatgaagatgatgacgatgatgacgatggtttattcggtttcggtgtgcgatttcgcgggcgacgtttaggttttcgagagttttgttgtcgtttattattgttgttttggcgttgattttcgttatcgttatcgttatgttgacgttttcgattagtatcgtttggtgttcgttgattatcgcggtcgcggtagttgtgacgattatggcggtgttggttttcgttcgagcggttttttcgtttttcgttttcgtgacgttatgaagaaatacgatgtcgggaacgattttcgttgtttcggcgcgttttgtttttcggcggttatttagatggttatggagatcgtcggtgtcgcgaggttgaggggtagtttatttcggcgacgttcgttgtttcggtggttcgtcgtcggtatttttagttgttggtcgttttggttgtgttttggtagtagttttttcgaacgtattattgagattggttatcgattttcgtagtcgttttgtttaacgtgcgagattattgttaagtacggggtcgtagggagttttttttagtattgcgttgacggtgtcgagatgttgggtcggcgtgatcgtttggtttttcgtttttgcgttagtttgtgtagatgtgttagttttatcgatggtaaatacgtcgcgcggtgtattggaagatgacgagttatagttttcgagtaggtgaaggatcgatggtttatggggatcgatgtcgattattttaacgaatcgatttgaggttaacgtcgttttttgttttttgtttgtgtttttgagggaggtttttgattgttggattt

SEQ ID NO: 40058 - DNA, 950 bp, Artificial Sequence
  chemically treated genomic DNA (Homo sapiens) CpG-island No: 40058
aaatccaacaatcaaaaacctccctcaaaaacacaaacaaaaaacaaaaaacgacgttaacctcaaatcgattcgttaaaataatcgacatcgatccccataaaccatcgatccttcacctactcgaaaactataactcgtcatcttccaatacaccgcgcgacgtatttaccatcgataaaactaacacatctacacaaactaacgcaaaaacgaaaaaccaaacgatcacgccgacccaacatctcgacaccgtcaacgcaatactaaaaaaaactccctacgaccccgtacttaacaataatctcgcacgttaaacaaaacgactacgaaaatcgataaccaatctcaataatacgttcgaaaaaactactaccaaaacacaaccaaaacgaccaacaactaaaaataccgacgacgaaccaccgaaacaacgaacgtcgccgaaataaactacccctcaacctcgcgacaccgacgatctccataaccatctaaataaccgccgaaaaacaaaacgcgccgaaacaacgaaaatcgttcccgacatcgtatttcttcataacgtcacgaaaacgaaaaacgaaaaaaccgctcgaacgaaaaccaacaccgccataatcgtcacaactaccgcgaccgcgataatcaacgaacaccaaacgatactaatcgaaaacgtcaacataacgataacgataacgaaaatcaacgccaaaacaacaataataaacgacaacaaaactctcgaaaacctaaacgtcgcccgcgaaatcgcacaccgaaaccgaataaaccatcgtcatcatcgtcatcatcttcatcttcgtcatccgataaacacccacgaaaaacacacgatcgccgacaacccaccgccctaacgctaaatataaaactttcaaccgttctctacgtaatatccgataacccgaaaaattccgacccga

SEQ ID NO: 40059 - DNA, 950 bp, Artificial Sequence
  chemically treated genomic DNA (Homo sapiens) CpG-island No: 40059
aggtttaatagttaggaattttttttaaggatatagataaggaataagaagcgacgttgattttagatcgattcgttggagtaatcgatatcgatttttatgagttatcggttttttatttattcgaagattatggttcgttattttttagtatatcgcgcgacgtgtttgttatcggtgggattaatatatttgtataggttaacgtagaggcggagaattagacggttacgtcgatttaatatttcggtatcgttaacgtaatattgagagaagttttttacgatttcgtgtttaataatgatttcgtacgttggatagaacgattacgggaatcggtagttaattttagtaatgcgttcgaggaagttgttattagagtataattagaacgattaatagttgaaggtgtcgacggcgaattatcgaagtagcggacgtcgtcgagatgagttattttttaatttcgcggtatcggcgatttttatgattatttgaatggtcgtcgagaagtaggacgcgtcgagataacgagaatcgttttcgatatcgtgtttttttatgacgttacgagaacgaagagcgaggaggtcgttcgaacgaggattaatatcgttatgatcgttataattgtcgcgatcgcgatgattagcgaatattagacgatgttggtcgagggcgttagtatgacggtgacgataacgggggttagcgttaggataataatggtggacgataatagaattttcgagaatttgaacgtcgttcgcggaatcgtatatcggagtcgagtgaattatcgttattatcgttattatttttattttcgttattcgatagatatttacggaggatatacgatcgtcgataatttatcgttttagcgttgggtgtagagtttttaatcgttttttacgtgatgttcgatggttcgagagatttcgattcgg

SEQ ID NO: 40060 - DNA, 950 bp, Artificial Sequence
  chemically treated genomic DNA (Homo sapiens) CpG-island No: 40060
ccgaatcgaaatctctcgaaccatcgaacatcacgtaaaaaacgattaaaaactctacacccaacgctaaaacgataaattatcgacgatcgtatatcctccgtaaatatctatcgaataacgaaaataaaaataataacgataataacgataattcactcgactccgatatacgattccgcgaacgacgttcaaattctcgaaaattctattatcgtccaccattattatcctaacgctaacccccgttatcgtcaccgtcatactaacgccctcgaccaacatcgtctaatattcgctaatcatcgcgatcgcgacaattataacgatcataacgatattaatcctcgttcgaacgacctcctcgctcttcgttctcgtaacgtcataaaaaaacacgatatcgaaaacgattctcgttatctcgacgcgtcctacttctcgacgaccattcaaataatcataaaaatcgccgataccgcgaaattaaaaaataactcatctcgacgacgtccgctacttcgataattcgccgtcgacaccttcaactattaatcgttctaattatactctaataacaacttcctcgaacgcattactaaaattaactaccgattcccgtaatcgttctatccaacgtacgaaatcattattaaacacgaaatcgtaaaaaacttctctcaatattacgttaacgataccgaaatattaaatcgacgtaaccgtctaattctccgcctctacgttaacctatacaaatatattaatcccaccgataacaaacacgtcgcgcgatatactaaaaaataacgaaccataatcttcgaataaataaaaaaccgataactcataaaaatcgatatcgattactccaacgaatcgatctaaaatcaacgtcgcttcttattccttatctatatccttaaaaaaaattcctaactattaaacct

SEQ ID NO: 40061 - DNA, 1165 bp, Artificial Sequence
  chemically treated genomic DNA (Homo sapiens) CpG-island No: 40061
tcggttatatcgacggtcgataagatttttttgttaattttggataagtttgttgttacgatattagtgatcgtgttatttgcgttcgattattttatttatgacgttatcgcggagattattaagacggttttcgtttaattattcgtttattattattttatcgtcggtcgtattttttgcgataatgacgacggcggttatttttatatcgattgtatcggcgaggatttcggggttacgttcgtggtcgcgttcgttaattgtattatggaggagtttatgtgtttcgtcgacgattaggttttcgacgacgagatagcggtggtgtagtagttcgtttttaattgtacgttcgacgatttttattatcgtttgttgtgggtgtaggttattatttttaattgtggaggtttcgtcgtcggggtgatatggagttatggcgtggttgacggtttcggtatagtatagtttatataagtcgtcggcgagttcgttcgtggtttgttatcgtcgttcgtcgtttcggttaggttggacgataagatcgtaatttaagtcgtatttttttttattatggtcgtttatcgttttatattcggttttaagttagtattaaatttcgacgtacgtaacgttatcgttttatttagttttattaattatattatcgtcggagttcgtcgtcgtgttatcgtgttcgaggcggtcgtcgtcgtgttttggtagtgtcgtatacgggtggtgatgacggattttgaggttttcgtcgtgttgtttttcgcggtgaacgtacgtaagtatttcggcgttaaggacggttattacggatgttgtatcgttatgtatatggtcgtgtttaagttcggtacggtggttaacggcgatattatgaagttggtcggtattatacgtcgcgttaaggagtagatatcggagtagttgaaggtagacgacggcgagatgatgttacggacgatggtaggggagaagtaggtgaatggatacgagagtttgttttatttgatattttggcgaaatatcgggttcgaggacgtcgatttcggtagcgggaagacggcgagggtgatgatttattcgtcgaggatgttgtttatgatgtttaggattgcgtttatttgttttatgtttaaggttatagagg

SEQ ID NO: 40062 - DNA, 1165 bp, Artificial Sequence
  chemically treated genomic DNA (Homo sapiens) CpG-island No: 40062
cctctataaccttaaacataaaacaaataaacgcaatcctaaacatcataaacaacatcctcgacgaataaatcatcaccctcgccgtcttcccgctaccgaaatcgacgtcctcgaacccgatatttcgccaaaatatcaaataaaacaaactctcgtatccattcacctacttctcccctaccatcgtccgtaacatcatctcgccgtcgtctaccttcaactactccgatatctactccttaacgcgacgtataataccgaccaacttcataatatcgccgttaaccaccgtaccgaacttaaacacgaccatatacataacgatacaacatccgtaataaccgtccttaacgccgaaatacttacgtacgttcaccgcgaaaaacaacacgacgaaaacctcaaaatccgtcatcaccacccgtatacgacactaccaaaacacgacgacgaccgcctcgaacacgataacacgacgacgaactccgacgataatataattaataaaactaaataaaacgataacgttacgtacgtcgaaatttaatactaacttaaaaccgaatataaaacgataaacgaccataataaaaaaaaatacgacttaaattacgatcttatcgtccaacctaaccgaaacgacgaacgacgataacaaaccacgaacgaactcgccgacgacttatataaactatactataccgaaaccgtcaaccacgccataactccatatcaccccgacgacgaaacctccacaattaaaaataataacctacacccacaacaaacgataataaaaatcgtcgaacgtacaattaaaaacgaactactacaccaccgctatctcgtcgtcgaaaacctaatcgtcgacgaaacacataaactcctccataatacaattaacgaacgcgaccacgaacgtaaccccgaaatcctcgccgatacaatcgatataaaaataaccgccgtcgtcattatcgcaaaaaatacgaccgacgataaaataataataaacgaataattaaacgaaaaccgtcttaataatctccgcgataacgtcataaataaaataatcgaacgcaaataacacgatcactaatatcgtaacaacaaacttatccaaaattaacaaaaaaatcttatcgaccgtcgatataaccga

SEQ ID NO: 40063 - DNA, 1165 bp, Artificial Sequence
  chemically treated genomic DNA (Homo sapiens) CpG-island No: 40063
tttttgtggttttgagtatgaagtagatgggcgtaattttgggtattatggatagtattttcggcgggtaggttattattttcgtcgttttttcgttgtcgaaatcgacgttttcgaattcgatgtttcgttaggatgttaagtagagtaggttttcgtatttatttatttgttttttttttattatcgttcgtagtattatttcgtcgtcgtttgtttttagttgtttcggtatttgttttttggcgcggcgtatgatgtcgattaattttatgatgtcgtcgttggttatcgtgtcggatttggatacggttatgtgtatggcggtgtagtattcgtagtagtcgtttttggcgtcgaggtatttgcgtgcgtttatcgcgaagagtagtacggcgggggttttaggattcgttattattattcgtgtacggtattgttagagtacggcggcgatcgtttcgaatacggtggtacgacgacgagtttcgacgatgatgtggttgataaggttagatgagacggtgacgttgcgtacgtcgaggtttgatattggtttgaggtcggatatgaagcgatgaacggttatggtgaagggaggtacggtttgggttgcgattttgtcgtttaatttgatcgggacgacggacggcgatggtaggttacgggcgagttcgtcgacggtttgtatgaattgtgttatgtcgggatcgttagttacgttatggttttatgttatttcgacgacgaagtttttatagttgagagtggtgatttgtatttatagtagacggtgatgaaggtcgtcgggcgtgtagttgaaggcgagttgttgtattatcgttgtttcgtcgtcgggagtttggtcgtcgacgagatatatgagtttttttatggtgtagttggcggacgcggttacgaacgtgatttcgagattttcgtcggtgtagtcgatgtagaaatggtcgtcgtcgttattgtcgtaggaaatgcggtcggcgataggatagtagtggacgagtgattgagcgagagtcgttttgatggttttcgcggtggcgttatggatggggtggtcgaacgtaagtagtacggttattggtatcgtggtaataggtttgtttaaagttgatagaaggattttgtcggtcgtcgatgtggtcgg

SEQ ID NO: 40064 - DNA, 1165 bp, Artificial Sequence
  chemically treated genomic DNA (Homo sapiens) CpG-island No: 40064
ccgaccacatcgacgaccgacaaaatccttctatcaactttaaacaaacctattaccacgataccaataaccgtactacttacgttcgaccaccccatccataacgccaccgcgaaaaccatcaaaacgactctcgctcaatcactcgtccactactatcctatcgccgaccgcatttcctacgacaataacgacgacgaccatttctacatcgactacaccgacgaaaatctcgaaatcacgttcgtaaccgcgtccgccaactacaccataaaaaaactcatatatctcgtcgacgaccaaactcccgacgacgaaacaacgataatacaacaactcgccttcaactacacgcccgacgaccttcatcaccgtctactataaatacaaatcaccactctcaactataaaaacttcgtcgtcgaaataacataaaaccataacgtaactaacgatcccgacataacacaattcatacaaaccgtcgacgaactcgcccgtaacctaccatcgccgtccgtcgtcccgatcaaattaaacgacaaaatcgcaacccaaaccgtacctcccttcaccataaccgttcatcgcttcatatccgacctcaaaccaatatcaaacctcgacgtacgcaacgtcaccgtctcatctaaccttatcaaccacatcatcgtcgaaactcgtcgtcgtaccaccgtattcgaaacgatcgccgccgtactctaacaataccgtacacgaataataataacgaatcctaaaacccccgccgtactactcttcgcgataaacgcacgcaaatacctcgacgccaaaaacgactactacgaatactacaccgccatacacataaccgtatccaaatccgacacgataaccaacgacgacatcataaaattaatcgacatcatacgccgcgccaaaaaacaaataccgaaacaactaaaaacaaacgacgacgaaataatactacgaacgataataaaaaaaaaacaaataaataaatacgaaaacctactctacttaacatcctaacgaaacatcgaattcgaaaacgtcgatttcgacaacgaaaaaacgacgaaaataataacctacccgccgaaaatactatccataatacccaaaattacgcccatctacttcatactcaaaaccacaaaaa

SEQ ID NO: 40065 - DNA, 720 bp, Artificial Sequence
  chemically treated genomic DNA (Homo sapiens) CpG-island No: 40065
tcgtcggcgagtttattcgtggtttgttatcgtcgttcgtcgtttcggttaggttagacgacgataataacgttatttaggttatattttttttcgttatggtcgtttattagtttatgtttagttttagttataaggtatttatcgattatatttttaataatattatcgtttcgtcgagtttgatcgattatattcgatttcgaggacgacgaattaacgacgacgttatcgtgttcgaggttgtcgtcgtcgtgttttggtagtgtcgtattcgggcggtgatgaaaaattcggaggttttcgtcgtattgtttttcgcggtgaatgcgcgaaagtatttcggagttaaggacgggtattacggaaattgtagtacgatgtacgtggtcgtggcgaagagcggcgcggtggcgaacgtcgatattaacgatattgtagatattatacggcgcgttaaggagcggatatcggagtagtttaagatgatcggcggtagcgatatgacgatgttacgggagttcgtcgatgattatcgtttggatggatatgagagtttgttttatttgatattatggcgaaatatcggattcgaagatgttgatttcggtagcgggaagacggcgagggtgatgatttattcgtagagggtggtgttttttatgtcgatgatggtaaaggttatgtcgatttgcgttatgtttaaggtaatagagtaag

SEQ ID NO: 40066 - DNA, 720 bp, Artificial Sequence
  chemically treated genomic DNA (Homo sapiens) CpG-island No: 40066
cttactctattaccttaaacataacgcaaatcgacataacctttaccatcatcgacataaaaaacaccaccctctacgaataaatcatcaccctcgccgtcttcccgctaccgaaatcaacatcttcgaatccgatatttcgccataatatcaaataaaacaaactctcatatccatccaaacgataatcatcgacgaactcccgtaacatcgtcatatcgctaccgccgatcatcttaaactactccgatatccgctccttaacgcgccgtataatatctacaatatcgttaatatcgacgttcgccaccgcgccgctcttcgccacgaccacgtacatcgtactacaatttccgtaatacccgtccttaactccgaaatactttcgcgcattcaccgcgaaaaacaatacgacgaaaacctccgaatttttcatcaccgcccgaatacgacactaccaaaacacgacgacgacaacctcgaacacgataacgtcgtcgttaattcgtcgtcctcgaaatcgaatataatcgatcaaactcgacgaaacgataatattattaaaaatataatcgataaataccttataactaaaactaaacataaactaataaacgaccataacgaaaaaaaatataacctaaataacgttattatcgtcgtctaacctaaccgaaacgacgaacgacgataacaaaccacgaataaactcgccgacga

SEQ ID NO: 40067 - DNA, 720 bp, Artificial Sequence
  chemically treated genomic DNA (Homo sapiens) CpG-island No: 40067
tttgttttgttgttttgagtatgacgtagatcggtatagtttttattattatcgatatggagagtattattttttgcgggtaggttattattttcgtcgttttttcgttgtcgaagttaatattttcgaattcgatgtttcgttatgatgttaagtagagtaggtttttatatttatttagacgatggttatcggcgagttttcgtagtatcgttatgtcgttgtcgtcggttattttgagttgtttcggtattcgttttttggcgcgtcgtatgatgtttataatgtcgttgatgtcggcgttcgttatcgcgtcgtttttcgttacggttacgtgtatcgtgttgtagttttcgtagtattcgtttttggtttcgagatattttcgcgtatttatcgcgaagagtagtacggcgggggttttcggattttttattatcgttcgggtacggtattgttaaagtacggcggcgatagtttcgaatacggtgacgtcgtcgttggttcgtcgttttcggaatcggatgtggtcgattaagttcgacgggacggtgatgttgttgaaggtgtggtcgatggatgttttgtggttggagttggatataaattgataaacggttatggcgaagggaggtatggtttgggtggcgttgttgtcgtcgtttaatttgatcgggacgacggacggcgatggtaggttacgggtgagttcgtcgacgg

SEQ ID NO: 40068 - DNA, 720 bp, Artificial Sequence
  chemically treated genomic DNA (Homo sapiens) CpG-island No: 40068
ccgtcgacgaactcacccgtaacctaccatcgccgtccgtcgtcccgatcaaattaaacgacgacaacaacgccacccaaaccatacctcccttcgccataaccgtttatcaatttatatccaactccaaccacaaaacatccatcgaccacaccttcaacaacatcaccgtcccgtcgaacttaatcgaccacatccgattccgaaaacgacgaaccaacgacgacgtcaccgtattcgaaactatcgccgccgtactttaacaataccgtacccgaacgataataaaaaatccgaaaacccccgccgtactactcttcgcgataaatacgcgaaaatatctcgaaaccaaaaacgaatactacgaaaactacaacacgatacacgtaaccgtaacgaaaaacgacgcgataacgaacgccgacatcaacgacattataaacatcatacgacgcgccaaaaaacgaataccgaaacaactcaaaataaccgacgacaacgacataacgatactacgaaaactcgccgataaccatcgtctaaataaatataaaaacctactctacttaacatcataacgaaacatcgaattcgaaaatattaacttcgacaacgaaaaaacgacgaaaataataacctacccgcaaaaaataatactctccatatcgataataataaaaactataccgatctacgtcatactcaaaacaacaaaacaaa

SEQ ID NO: 40069 - DNA, 653 bp, Artificial Sequence
  chemically treated genomic DNA (Homo sapiens) CpG-island No: 40069
gtcggaggtagatgtgacgtgggggtatatttgttcgtttagttaaatgtgatcggtgataggtcggttatagattagatgtgatcgacgacgggatgtgtgagcgtaagtttttttatcgagagtggcgatagttttttgaggtatttggaattttagattttcgttgttatcgttatcgtcggcgggggttttttttttagatttttttcgttgattattggttggggtcgtgagggttttgttttttcgtcgattttgtcgtttttttttatcggtttttcgaaatcgttcggttaagtttttgatcgagcggtagtcggtaagattgtgtcgataagtattgtgtatcgagtattatttgttcgcggatcgatttttattagaaggggcggtatagttcgttttgtcgtcggtggttttttttttgcgcggggttcgcgagggtttattagtcgtaaggacgtggttttcgttattagagcgggttggttttcgtttgttttttttgtttcgtcgtttggagcggggggtagtttcgggggcggtcgttgtcgtcgtatcggtgttgggggagttttaagtttacgttttttttttttgagttattttgttcgttagttcgaagagtttagcggtggttttaggttttt

SEQ ID NO: 40070 - DNA, 653 bp, Artificial Sequence
  chemically treated genomic DNA (Homo sapiens) CpG-island No: 40070
aaaaacctaaaaccaccgctaaactcttcgaactaacgaacaaaataactcaaaaaaaaaaaacgtaaacttaaaactcccccaacaccgatacgacgacaacgaccgcccccgaaactaccccccgctccaaacgacgaaacaaaaaaaacaaacgaaaaccaacccgctctaataacgaaaaccacgtccttacgactaataaaccctcgcgaaccccgcgcaaaaaaaaaaccaccgacgacaaaacgaactataccgccccttctaataaaaatcgatccgcgaacaaataatactcgatacacaatacttatcgacacaatcttaccgactaccgctcgatcaaaaacttaaccgaacgatttcgaaaaaccgataaaaaaaaacgacaaaatcgacgaaaaaacaaaaccctcacgaccccaaccaataatcaacgaaaaaaatctaaaaaaaaaacccccgccgacgataacgataacaacgaaaatctaaaattccaaatacctcaaaaaactatcgccactctcgataaaaaaacttacgctcacacatcccgtcgtcgatcacatctaatctataaccgacctatcaccgatcacatttaactaaacgaacaaatatacccccacgtcacatctacctccgac

SEQ ID NO: 40071 - DNA, 653 bp, Artificial Sequence
  chemically treated genomic DNA (Homo sapiens) CpG-island No: 40071
aggagtttaagattatcgttgagtttttcgagttagcggataaggtggtttagaaggaggaggcgtgggtttggaatttttttagtatcggtgcggcggtagcggtcgttttcgagattgtttttcgttttaagcggcgggatagaaggggtaagcggaagttagttcgttttgatgacgagggttacgtttttgcggttgatgggttttcgcgggtttcgcgtagggaaagggttatcgacggtaagacgagttatatcgttttttttggtaagggtcggttcgcggataagtggtgttcggtgtataatatttatcggtatagttttgtcgattgtcgttcggttaagaatttggtcgagcggtttcgaaaagtcgatgaggagaagcggtagagtcgacgggagggtaaagtttttacgattttagttaatgattagcgagaggagtttaagaagaaggttttcgtcgacgatggcgatgatagcgagggtttggagttttaggtattttagggaattgtcgttattttcgatgggggggtttgcgtttatatatttcgtcgtcggttatatttgatttgtgatcggtttgttatcggttatatttgattggacggatagatgtgtttttacgttatatttattttcggt

SEQ ID NO: 40072 - DNA, 653 bp, Artificial Sequence
  chemically treated genomic DNA (Homo sapiens) CpG-island No: 40072
accgaaaataaatataacgtaaaaacacatctatccgtccaatcaaatataaccgataacaaaccgatcacaaatcaaatataaccgacgacgaaatatataaacgcaaacccccccatcgaaaataacgacaattccctaaaatacctaaaactccaaaccctcgctatcatcgccatcgtcgacgaaaaccttcttcttaaactcctctcgctaatcattaactaaaatcgtaaaaactttaccctcccgtcgactctaccgcttctcctcatcgacttttcgaaaccgctcgaccaaattcttaaccgaacgacaatcgacaaaactataccgataaatattatacaccgaacaccacttatccgcgaaccgacccttaccaaaaaaaacgatataactcgtcttaccgtcgataaccctttccctacgcgaaacccgcgaaaacccatcaaccgcaaaaacgtaaccctcgtcatcaaaacgaactaacttccgcttaccccttctatcccgccgcttaaaacgaaaaacaatctcgaaaacgaccgctaccgccgcaccgatactaaaaaaattccaaacccacgcctcctccttctaaaccaccttatccgctaactcgaaaaactcaacgataatcttaaactcct

SEQ ID NO: 40073 - DNA, 722 bp, Artificial Sequence
  chemically treated genomic DNA (Homo sapiens) CpG-island No: 40073
tcggagattcgttacgaaggttttgtaattagttttttttggggtggacgtgaggggcgggtcgtcgcgcgaggagaaacgcggtattttagacgaggaggcgtttttttttatgcgggtagcgcggcgttcgtttcgtcgacgtttaatgttgattcgagcgttttgtttttcgtataggttatcgtgacgttttcgatttttcgaggtttttgacgacgttggggtcgtagatcgttttgaggttgtggttattcgacgggtttttttttttgttgacgaggagagggtggtggaggtacgtgatgtatttgtggcggtggaacggttatttacggttaatcgtcgttgggtagtggtgattaagttggcgacgtcgtttaattatcgttggacgggggttttcggttttacgtttatcggggggtgtcgtaggagggttttttttgtttaaagcgcgttttggggcgagttgtcgtcgcggtaggttaggtagcggcgcgttcggacgtgttatggtttttttttatttagaggcggggagagggtcgagttattcgattaggcgtgaattttttttcgtagggggtcggagaggggcggagttcgcgagtcgcgtcggcggtgacgcgggttgcgattttcgttggtatttttatttttggaaggagtaagggtttgtatttttatttttttttttaaaatttttattatgatcgttg

SEQ ID NO: 40074 - DNA, 722 bp, Artificial Sequence
  chemically treated genomic DNA (Homo sapiens) CpG-island No: 40074
caacgatcataataaaaattttaaaaaaaaaaataaaaatacaaacccttactccttccaaaaataaaaataccaacgaaaatcgcaacccgcgtcaccgccgacgcgactcgcgaactccgcccctctccgaccccctacgaaaaaaaattcacgcctaatcgaataactcgaccctctccccgcctctaaataaaaaaaaaccataacacgtccgaacgcgccgctacctaacctaccgcgacgacaactcgccccaaaacgcgctttaaacaaaaaaaaccctcctacgacaccccccgataaacgtaaaaccgaaaacccccgtccaacgataattaaacgacgtcgccaacttaatcaccactacccaacgacgattaaccgtaaataaccgttccaccgccacaaatacatcacgtacctccaccaccctctcctcgtcaacaaaaaaaaaaacccgtcgaataaccacaacctcaaaacgatctacgaccccaacgtcgtcaaaaacctcgaaaaatcgaaaacgtcacgataacctatacgaaaaacaaaacgctcgaatcaacattaaacgtcgacgaaacgaacgccgcgctacccgcataaaaaaaaacgcctcctcgtctaaaataccgcgtttctcctcgcgcgacgacccgcccctcacgtccaccccaaaaaaaactaattacaaaaccttcgtaacgaatctccga

SEQ ID NO: 40075 - DNA, 722 bp, Artificial Sequence
  chemically treated genomic DNA (Homo sapiens) CpG-island No: 40075
taacgattatggtggaggttttagaggaagaggtggaggtgtagatttttattttttttaggagtgaaggtgttagcgggagtcgtaattcgcgttatcgtcgacgcggttcgcggatttcgttttttttcgattttttgcggagggaggtttacgtttgatcgggtggttcggtttttttttcgtttttggatggggggaggttatggtacgttcgagcgcgtcgttgtttgatttatcgcgacggtagttcgttttagggcgcgttttaggtagggggagtttttttgcggtatttttcggtgaacgtggagtcggaggttttcgtttaacgatggttggacgacgtcgttaatttggttattattgtttagcggcggttggtcgtaagtggtcgttttatcgttataggtatattacgtatttttattatttttttttcgttagtaaggaggagggttcgtcggatagttatagttttaaggcgatttacggttttaacgtcgttaggggtttcggaaagtcggaggcgttacgatagtttatacggggagtaggacgttcgagttaatattgagcgtcgacgagacgagcgtcgcgttattcgtatgggagaaggcgttttttcgtttggagtgtcgcgttttttttcgcgcggcggttcgttttttacgtttattttagggggaattggttataaggttttcgtggcgagttttcgg

SEQ ID NO: 40076 - DNA, 722 bp, Artificial Sequence
  chemically treated genomic DNA (Homo sapiens) CpG-island No: 40076
ccgaaaactcgccacgaaaaccttataaccaattccccctaaaataaacgtaaaaaacgaaccgccgcgcgaaaaaaaacgcgacactccaaacgaaaaaacgccttctcccatacgaataacgcgacgctcgtctcgtcgacgctcaatattaactcgaacgtcctactccccgtataaactatcgtaacgcctccgactttccgaaacccctaacgacgttaaaaccgtaaatcgccttaaaactataactatccgacgaaccctcctccttactaacgaaaaaaaaataataaaaatacgtaatatacctataacgataaaacgaccacttacgaccaaccgccgctaaacaataataaccaaattaacgacgtcgtccaaccatcgttaaacgaaaacctccgactccacgttcaccgaaaaataccgcaaaaaaactccccctacctaaaacgcgccctaaaacgaactaccgtcgcgataaatcaaacaacgacgcgctcgaacgtaccataacctccccccatccaaaaacgaaaaaaaaaccgaaccacccgatcaaacgtaaacctccctccgcaaaaaatcgaaaaaaaacgaaatccgcgaaccgcgtcgacgataacgcgaattacgactcccgctaacaccttcactcctaaaaaaaataaaaatctacacctccacctcttcctctaaaacctccaccataatcgtta

SEQ ID NO: 40077 - DNA, 509 bp, Artificial Sequence
  chemically treated genomic DNA (Homo sapiens) CpG-island No: 40077
gcggcggtgcgcggttgcgcgtggtggcgcgcgcggtagcggcggcgtatgcggtagcgttatgcggggcgcggtcgatattgcggcgttgcggtgcgcgcgcgggcgttagaggcgttgtgcggtgggcgtggaatcgggtagcggcgttgtgcggggcgcggttgttggaagttcgcggtagtcgcgcgcggcgtgcggcgacgtcgggcggggcgcggtcggcggtagttcgcggtaatgcgaacggttgttacgacggcgggcggcggtgtcgtgcggggtatagtcggcggcggtttacggcggtgcggcggcgtggtcggcgtcgtaacgtgatgttatgttgcgtcgtgttttcgattcgtgtttgtattggtgaggttcgtttttgttatgatggatgatgtcgagaaaattttaattaattagatgtcgacgattttatttcggcgacggcggtttttatcgggagttataaaaacggaacgaggaatatgtaaagattt

SEQ ID NO: 40078 - DNA, 509 bp, Artificial Sequence
  chemically treated genomic DNA (Homo sapiens) CpG-island No: 40078
aaatctttacatattcctcgttccgtttttataactcccgataaaaaccgccgtcgccgaaataaaatcgtcgacatctaattaattaaaattttctcgacatcatccatcataacaaaaacgaacctcaccaatacaaacacgaatcgaaaacacgacgcaacataacatcacgttacgacgccgaccacgccgccgcaccgccgtaaaccgccgccgactataccccgcacgacaccgccgcccgccgtcgtaacaaccgttcgcattaccgcgaactaccgccgaccgcgccccgcccgacgtcgccgcacgccgcgcgcgactaccgcgaacttccaacaaccgcgccccgcacaacgccgctacccgattccacgcccaccgcacaacgcctctaacgcccgcgcgcgcaccgcaacgccgcaatatcgaccgcgccccgcataacgctaccgcatacgccgccgctaccgcgcgcgccaccacgcgcaaccgcgcaccgccgc

SEQ ID NO: 40079 - DNA, 509 bp, Artificial Sequence
  chemically treated genomic DNA (Homo sapiens) CpG-island No: 40079
aaatttttgtatgtttttcgtttcgtttttgtaattttcgatgaaaatcgtcgtcgtcgaggtggagtcgtcggtatttagttgattggggttttttcggtattatttattatggtagagacgaattttattaatgtaagtacggatcggagatacgacgtagtatggtattacgttgcgacgtcgattacgtcgtcgtatcgtcgtgagtcgtcgtcggttgtgtttcgtacggtatcgtcgttcgtcgtcgtagtagtcgttcgtattgtcgcgagttgtcgtcggtcgcgtttcgttcggcgtcgtcgtacgtcgcgcgcggttgtcgcgagtttttaatagtcgcgtttcgtatagcgtcgttgttcgattttacgtttatcgtatagcgtttttagcgttcgcgcgcgtatcgtaacgtcgtaatgtcggtcgcgtttcgtatggcgttgtcgtatgcgtcgtcgttgtcgcgcgcgttattacgcgtagtcgcgtatcgtcgt

SEQ ID NO: 40080 - DNA, 509 bp, Artificial Sequence
  chemically treated genomic DNA (Homo sapiens) CpG-island No: 40080
acgacgatacgcgactacgcgtaataacgcgcgcgacaacgacgacgcatacgacaacgccatacgaaacgcgaccgacattacgacgttacgatacgcgcgcgaacgctaaaaacgctatacgataaacgtaaaatcgaacaacgacgctatacgaaacgcgactattaaaaactcgcgacaaccgcgcgcgacgtacgacgacgccgaacgaaacgcgaccgacgacaactcgcgacaatacgaacgactactacgacgacgaacgacgataccgtacgaaacacaaccgacgacgactcacgacgatacgacgacgtaatcgacgtcgcaacgtaataccatactacgtcgtatctccgatccgtacttacattaataaaattcgtctctaccataataaataataccgaaaaaaccccaatcaactaaataccgacgactccacctcgacgacgacgattttcatcgaaaattacaaaaacgaaacgaaaaacatacaaaaattt

SEQ ID NO: 40081 - DNA, 565 bp, Artificial Sequence
  chemically treated genomic DNA (Homo sapiens) CpG-island No: 40081
ttatttacgttttgcgtttcgtgttcggcgtcggcgtcggcgcgggattttttttattttcgttcgttttttcgtagtcgtttttttcgtcgttcgttttttattcgtcgttatcgatgttattcgtttttttttcgtttttcgttgattttttttgtaggtcgtgcgacggcgcggttcgtggtttcgttttcggtgtcgtcgtagttagattcggttttttcgcggttggatttagtttcgttgtcgtcggatttggcggtcggaggagacggcgcgacggaggaggatgatcgcgataggttcgtacgacgaagcggcggaggtcgatgggtgtggtattatcgtcgtttttatcgttcgttttttttgcgatattatatttttttttttgttttttttttattttatttatcgataacgaggtttgtggcggcggcgtattcggttgtgtacgggcgttgtgttatcgtcgtttgttattttaatcgggtgtttttttggttcgattgagatggtttttttgtgacggtttattaattttaggtattttagaggttattat

SEQ ID NO: 40082 - DNA, 565 bp, Artificial Sequence
  chemically treated genomic DNA (Homo sapiens) CpG-island No: 40082
ataataacctctaaaatacctaaaattaataaaccgtcacaaaaaaaccatctcaatcgaaccaaaaaaacacccgattaaaataacaaacgacgataacacaacgcccgtacacaaccgaatacgccgccgccacaaacctcgttatcgataaataaaataaaaaaaaaacaaaaaaaaaaatataatatcgcaaaaaaaacgaacgataaaaacgacgataataccacacccatcgacctccgccgcttcgtcgtacgaacctatcgcgatcatcctcctccgtcgcgccgtctcctccgaccgccaaatccgacgacaacgaaactaaatccaaccgcgaaaaaaccgaatctaactacgacgacaccgaaaacgaaaccacgaaccgcgccgtcgcacgacctacaaaaaaaatcaacgaaaaacgaaaaaaaaacgaataacatcgataacgacgaataaaaaacgaacgacgaaaaaaacgactacgaaaaaacgaacgaaaataaaaaaaatcccgcgccgacgccgacgccgaacacgaaacgcaaaacgtaaataa

SEQ ID NO: 40083 - DNA, 565 bp, Artificial Sequence
  chemically treated genomic DNA (Homo sapiens) CpG-island No: 40083
atgatggtttttaaaatatttgaaattagtgggtcgttataaggaagttattttaatcgggttaaaaaagtattcgattgagatgataggcggcggtggtatagcgttcgtgtatagtcggatgcgtcgtcgttataagtttcgttgtcggtgggtggggtggggggagaataagggggggagtgtggtgtcgtagggaaggcggacgatgaaggcgacgatggtgttatatttatcggttttcgtcgtttcgtcgtacgaatttatcgcggttattttttttcgtcgcgtcgtttttttcggtcgttagattcggcggtagcggagttggatttagtcgcgggagggtcggatttgattacggcggtatcgaagacgaggttacgagtcgcgtcgtcgtacggtttgtaaggagagttaacggagaacggggggaggacggatgatatcggtggcggcgggtagagggcggacgacgagggaggcgattgcgggagggcggacggaggtggggggagtttcgcgtcggcgtcggcgtcgagtacgaggcgtagggcgtgggtgg

SEQ ID NO: 40084 - DNA, 565 bp, Artificial Sequence
  chemically treated genomic DNA (Homo sapiens) CpG-island No: 40084
ccacccacgccctacgcctcgtactcgacgccgacgccgacgcgaaactccccccacctccgtccgccctcccgcaatcgcctccctcgtcgtccgccctctacccgccgccaccgatatcatccgtcctccccccgttctccgttaactctccttacaaaccgtacgacgacgcgactcgtaacctcgtcttcgataccgccgtaatcaaatccgaccctcccgcgactaaatccaactccgctaccgccgaatctaacgaccgaaaaaaacgacgcgacgaaaaaaaataaccgcgataaattcgtacgacgaaacgacgaaaaccgataaatataacaccatcgtcgccttcatcgtccgccttccctacgacaccacactcccccccttattctccccccaccccacccaccgacaacgaaacttataacgacgacgcatccgactatacacgaacgctataccaccgccgcctatcatctcaatcgaatacttttttaacccgattaaaataacttccttataacgacccactaatttcaaatattttaaaaaccatcat

SEQ ID NO: 40085 - DNA, 927 bp, Artificial Sequence
  chemically treated genomic DNA (Homo sapiens) CpG-island No: 40085
aggtcgacgtcgaagtttagaggatgatcggcgacgtgtcggttgtcgagtatagttagttgtttatacgataggcggtcggtcgggtaaatcgggtttacgatagcgcgggtaagtgaagttggtttttaggaagcgaagggtttttttttttttttattttgacgtcgacgacgaggacgacgtcgaagatcgtgacgacgaggaggaaggcgaggaggaagaggaggcggaggttatggtcggaagggttgcggacgacgcggtcgaaaatcgcgttgaaatttttggttatatttttattttaagttcggggtataatgagatcggggtagagtcgaatagtttttttttttatcgaagggattcggaggtggcgagagcgttaatcgcgtttttagttggtaaggtggagaaggggagtttagttaaaaaggtcgttaagaagagaggattcgttaacgttggtcgtgtttttagcgacgacgagttttttgacgaaatttcgatttcgttcgtcggttattgtttagatttttcgatcgttttcgttttttcgatcgacgttagtagagcgggtggtagtggcgttgtcgtggttttagttttcgttgatcgcgtcgtgtaagttgcggttagggttttcggaagttttttgtgttagtcggtcgtttcgtcgttggtttagtcgaaggggaagggggcggtcgtcgaaatatttgtttcggattattttttcgtggcgttttattttgtttttggcgattttgagattcgggcggagtttattttttttgtcgagtgggtaagtaattttgtttcgtttgttagtatttcgagtttatttatcgaattgaatgagttcgacgaggggtgtttcgttattaaaagtttggcgttttgggtatgtttttttttttttagttt

SEQ ID NO: 40086 - DNA, 927 bp, Artificial Sequence
  chemically treated genomic DNA (Homo sapiens) CpG-island No: 40086
aaactaaaaaaaaaaaaacatacccaaaacgccaaacttttaataacgaaacacccctcgtcgaactcattcaattcgataaataaactcgaaatactaacaaacgaaacaaaattacttacccactcgacaaaaaaaataaactccgcccgaatctcaaaatcgccaaaaacaaaataaaacgccacgaaaaaataatccgaaacaaatatttcgacgaccgcccccttccccttcgactaaaccaacgacgaaacgaccgactaacacaaaaaacttccgaaaaccctaaccgcaacttacacgacgcgatcaacgaaaactaaaaccacgacaacgccactaccacccgctctactaacgtcgatcgaaaaaacgaaaacgatcgaaaaatctaaacaataaccgacgaacgaaatcgaaatttcgtcaaaaaactcgtcgtcgctaaaaacacgaccaacgttaacgaatcctctcttcttaacgacctttttaactaaactccccttctccaccttaccaactaaaaacgcgattaacgctctcgccacctccgaatcccttcgataaaaaaaaaaactattcgactctaccccgatctcattataccccgaacttaaaataaaaatataaccaaaaatttcaacgcgattttcgaccgcgtcgtccgcaacccttccgaccataacctccgcctcctcttcctcctcgccttcctcctcgtcgtcacgatcttcgacgtcgtcctcgtcgtcgacgtcaaaataaaaaaaaaaaaaaacccttcgcttcctaaaaaccaacttcacttacccgcgctatcgtaaacccgatttacccgaccgaccgcctatcgtataaacaactaactatactcgacaaccgacacgtcgccgatcatcctctaaacttcgacgtcgacct

SEQ ID NO: 40087 - DNA, 927 bp, Artificial Sequence
  chemically treated genomic DNA (Homo sapiens) CpG-island No: 40087
gagttaaaaaaaagggggtatatttaaagcgttaagtttttgatagcggaatatttttcgtcgaatttatttagttcggtgaatagattcggggtgttggtaggcgagataaggttgtttatttattcgataaagggaatgagtttcgttcgggttttaaaatcgttaggggtaaagtggggcgttacgagagaataattcgaggtagatgtttcgacggtcgtttttttttttttcggttagattagcggcgaaacgatcggttgatataaggggttttcgaaaattttagtcgtagtttgtacgacgcgattagcggaggttgaggttacggtagcgttattgttattcgttttgttaacgtcgatcgaaagaacgggggcggtcgaaagatttaagtaatgatcggcgggcgaagtcggggtttcgttagaagattcgtcgtcgttaaaaatacgattaacgttgacgagttttttttttttggcggtttttttaattggattttttttttttattttgttagttgaaaacgcgattagcgttttcgttattttcgaattttttcgatgaaggggggagttattcgattttatttcggttttattgtgtttcggatttggagtgggagtgtagttaggggttttaacgcggttttcgatcgcgtcgttcgtagttttttcgattatggttttcgtttttttttttttttcgttttttttttcgtcgttacgattttcgacgtcgttttcgtcgtcggcgttagaatgagaggaggaaggggtttttcgttttttaggggttagttttatttgttcgcgttgtcgtaaattcgatttgttcggtcggtcgtttgtcgtgtaagtaattggttgtattcgataatcgatacgtcgtcgattattttttgggtttcggcgtcggttt

SEQ ID NO: 40088 - DNA, 927 bp, Artificial Sequence
  chemically treated genomic DNA (Homo sapiens) CpG-island No: 40088
aaaccgacgccgaaacccaaaaaataatcgacgacgtatcgattatcgaatacaaccaattacttacacgacaaacgaccgaccgaacaaatcgaatttacgacaacgcgaacaaataaaactaacccctaaaaaacgaaaaaccccttcctcctctcattctaacgccgacgacgaaaacgacgtcgaaaatcgtaacgacgaaaaaaaaaacgaaaaaaaaaaaaaaacgaaaaccataatcgaaaaaactacgaacgacgcgatcgaaaaccgcgttaaaacccctaactacactcccactccaaatccgaaacacaataaaaccgaaataaaatcgaataactccccccttcatcgaaaaaattcgaaaataacgaaaacgctaatcgcgttttcaactaacaaaataaaaaaaaaaaatccaattaaaaaaaccgccaaaaaaaaaaaactcgtcaacgttaatcgtatttttaacgacgacgaatcttctaacgaaaccccgacttcgcccgccgatcattacttaaatctttcgaccgcccccgttctttcgatcgacgttaacaaaacgaataacaataacgctaccgtaacctcaacctccgctaatcgcgtcgtacaaactacgactaaaattttcgaaaaccccttatatcaaccgatcgtttcgccgctaatctaaccgaaaaaaaaaaaaacgaccgtcgaaacatctacctcgaattattctctcgtaacgccccactttacccctaacgattttaaaacccgaacgaaactcattccctttatcgaataaataaacaaccttatctcgcctaccaacaccccgaatctattcaccgaactaaataaattcgacgaaaaatattccgctatcaaaaacttaacgctttaaatatacccccttttttttaactc

SEQ ID NO: 40089 - DNA, 1587 bp, Artificial Sequence
  chemically treated genomic DNA (Homo sapiens) CpG-island No: 40089
tcgcggtagatcgagtatatagagacggtttacgggtcgacggaagcggatttcgtgtgttaatcgaggcgagtggttaataaacggattttattagatattacgcgggttgtatacgtgaaattacgcggttatcgagcgggtatattaatagggttattatacgtataagcgaacgattatcgatatcggtatacgggtattggggtcgataatcgtataacgggtacggggcgatatcgaaaggatgaggacggggtagcgagaggagagatttatattattacgcgacgaggcgagggaacgataacgacgaacgggcgcggcgtagacgaacggcgagggaacgatttcggcggcgatttttggacgaaggcgagatacggtcggtataaggtttgatgacgcggagtcgaggacgaagacgataacggggttgttacggttcgtttgatggacgcggacgacggacgagaacggtttgacggagggacgaatattacgacgatgaggacgacgatcgggatcggcgaggaggtaacgagggtagtcggcggtagttgtatagagattaggacggcgtggaatatatcgttgcgaattcgacgacggaggcggcgtagcgagacgacgagtcggcgaggaggaacgatcgatcggaggagtcgtcgacgaggacgaacggagacgacgataacgaatatcggcggggtttagatggaggggaggcgaggtcgagggcgattttgtcgttgcgatgtcggaggtggtggtggtgcggtcgacggtgtacgggtggaggaagggtcgatcggggaaatttcggcgaggcggatggagaggttcgcggcgatgtgcggcggttttcgggcgaattcgaggagtggatgaggtggagggttacgttatcgtgtcgagggaggagacggtagcgtcggttgacgtacgggtacggcggaaggggttgtcgaaggaatttcggcgaggcggagggcgagatcggcgcgggcgacgacgtttcggcgaaattcgagcgatgtcgtggtttggtcggggaagaggatggcgttgttgtgtcgggagaggtagcgacgatggaagacgacgttttggtaaagcgatataggcggttggaggtggtatagtggcggtaacgttattgtatattagcgaggaagcgttttcgttggttttcgtgcgaaacggagggtaggtcggcgtagaggggatatttgcgaggtcgaggaaggtggtggcgacgttagtcgtcgtacgggagaggcggtataggcggttggagggtagtcggcgtcgaggaaagagaaggaggaggcggggagaggtggtgcggttacgggggagttcgggaaggggttaaaacgagggaacggagcgagggggttttattttataggtaaagggaaggagtcggttacgggaggagcggggaacggcggcggaaaattcggtcggcggttatggaaggtggtcggggttggcgcgttcgtttttggcgatttaaggcgttatttaaggggaaaattaggggtaattgaagaggaaggaatggggattaaaattttttaa

SEQ ID NO: 40090 - DNA, 1587 bp, Artificial Sequence
  chemically treated genomic DNA (Homo sapiens) CpG-island No: 40090
ttaaaaaattttaatccccattccttcctcttcaattacccctaattttccccttaaataacgccttaaatcgccaaaaacgaacgcgccaaccccgaccaccttccataaccgccgaccgaattttccgccgccgttccccgctcctcccgtaaccgactccttccctttacctataaaataaaaccccctcgctccgttccctcgttttaaccccttcccgaactcccccgtaaccgcaccacctctccccgcctcctccttctctttcctcgacgccgactaccctccaaccgcctataccgcctctcccgtacgacgactaacgtcgccaccaccttcctcgacctcgcaaatatcccctctacgccgacctaccctccgtttcgcacgaaaaccaacgaaaacgcttcctcgctaatatacaataacgttaccgccactataccacctccaaccgcctatatcgctttaccaaaacgtcgtcttccatcgtcgctacctctcccgacacaacaacgccatcctcttccccgaccaaaccacgacatcgctcgaatttcgccgaaacgtcgtcgcccgcgccgatctcgccctccgcctcgccgaaattccttcgacaaccccttccgccgtacccgtacgtcaaccgacgctaccgtctcctccctcgacacgataacgtaaccctccacctcatccactcctcgaattcgcccgaaaaccgccgcacatcgccgcgaacctctccatccgcctcgccgaaatttccccgatcgacccttcctccacccgtacaccgtcgaccgcaccaccaccacctccgacatcgcaacgacaaaatcgccctcgacctcgcctcccctccatctaaaccccgccgatattcgttatcgtcgtctccgttcgtcctcgtcgacgactcctccgatcgatcgttcctcctcgccgactcgtcgtctcgctacgccgcctccgtcgtcgaattcgcaacgatatattccacgccgtcctaatctctatacaactaccgccgactaccctcgttacctcctcgccgatcccgatcgtcgtcctcatcgtcgtaatattcgtccctccgtcaaaccgttctcgtccgtcgtccgcgtccatcaaacgaaccgtaacaaccccgttatcgtcttcgtcctcgactccgcgtcatcaaaccttataccgaccgtatctcgccttcgtccaaaaatcgccgccgaaatcgttccctcgccgttcgtctacgccgcgcccgttcgtcgttatcgttccctcgcctcgtcgcgtaataatataaatctctcctctcgctaccccgtcctcatcctttcgatatcgccccgtacccgttatacgattatcgaccccaatacccgtataccgatatcgataatcgttcgcttatacgtataataaccctattaatatacccgctcgataaccgcgtaatttcacgtatacaacccgcgtaatatctaataaaatccgtttattaaccactcgcctcgattaacacacgaaatccgcttccgtcgacccgtaaaccgtctctatatactcgatctaccgcga

SEQ ID NO: 40091 - DNA, 1587 bp, Artificial Sequence
  chemically treated genomic DNA (Homo sapiens) CpG-island No: 40091
ttagggggttttaatttttatttttttttttttaattgtttttaattttttttttgaatagcgttttaaatcgttaggaacggacgcgttaatttcggttattttttatggtcgtcggtcgagtttttcgtcgtcgtttttcgtttttttcgtggtcggttttttttttttgtttataaaatggaattttttcgtttcgttttttcgttttagttttttttcgagttttttcgtggtcgtattattttttttcgtttttttttttttttttttcggcgtcggttattttttagtcgtttgtgtcgtttttttcgtgcggcggttgacgtcgttattatttttttcggtttcgtaggtgttttttttacgtcggtttgtttttcgtttcgtacggggattaacggagacgttttttcgttggtgtatagtggcgttgtcgttattgtattatttttagtcgtttgtgtcgttttgttagagcgtcgttttttatcgtcgttgtttttttcggtatagtagcgttattttttttttcggttaggttacggtatcgttcgaatttcgtcggaacgtcgtcgttcgcgtcggtttcgtttttcgtttcgtcggagttttttcggtagtttttttcgtcgtgttcgtgcgttagtcggcgttgtcgttttttttttcggtacggtgacgtagttttttattttatttatttttcggattcgttcggaagtcgtcgtatatcgtcgcgaatttttttattcgtttcgtcggaattttttcggtcggttttttttttattcgtgtatcgtcggtcgtattattattattttcggtatcgtagcggtagggtcgttttcgatttcgttttttttttatttgaatttcgtcggtgttcgttatcgtcgttttcgttcgttttcgtcgacgattttttcggtcggtcgttttttttcgtcggttcgtcgtttcgttgcgtcgttttcgtcgtcggattcgtagcggtgtgttttacgtcgttttagtttttgtgtagttgtcgtcggttgttttcgttgttttttcgtcggtttcggtcgtcgtttttatcgtcgtggtgttcgttttttcgttaagtcgttttcgttcgtcgttcgcgtttattaagcgagtcgtggtagtttcgttgtcgttttcgttttcggtttcgcgttattaagttttgtgtcggtcgtgtttcgttttcgtttaaggatcgtcgtcgaagtcgttttttcgtcgttcgtttacgtcgcgttcgttcgtcgttgtcgttttttcgtttcgtcgcgtggtggtatggattttttttttcgttgtttcgtttttattttttcggtgtcgtttcgtattcgttgtgcggttgtcgattttagtattcgtgtatcggtgtcggtagtcgttcgtttgtacgtgtggtgattttgttagtgtgttcgttcggtagtcgcgtggttttacgtgtgtagttcgcgtggtgtttagtggagttcgtttgttggttattcgtttcggttgatatacggggttcgttttcgtcgattcgtggatcgtttttgtgtattcggtttatcgcgg

SEQ ID NO: 40092 - DNA, 1587 bp, Artificial Sequence
  chemically treated genomic DNA (Homo sapiens) CpG-island No: 40092
ccgcgataaaccgaatacacaaaaacgatccacgaatcgacgaaaacgaaccccgtatatcaaccgaaacgaataaccaacaaacgaactccactaaacaccacgcgaactacacacgtaaaaccacgcgactaccgaacgaacacactaacaaaatcaccacacgtacaaacgaacgactaccgacaccgatacacgaatactaaaatcgacaaccgcacaacgaatacgaaacgacaccgaaaaaataaaaacgaaacaacgaaaaaaaaaatccataccaccacgcgacgaaacgaaaaaacgacaacgacgaacgaacgcgacgtaaacgaacgacgaaaaaacgacttcgacgacgatccttaaacgaaaacgaaacacgaccgacacaaaacttaataacgcgaaaccgaaaacgaaaacgacaacgaaactaccacgactcgcttaataaacgcgaacgacgaacgaaaacgacttaacgaaaaaacgaacaccacgacgataaaaacgacgaccgaaaccgacgaaaaaacaacgaaaacaaccgacgacaactacacaaaaactaaaacgacgtaaaacacaccgctacgaatccgacgacgaaaacgacgcaacgaaacgacgaaccgacgaaaaaaaacgaccgaccgaaaaaatcgtcgacgaaaacgaacgaaaacgacgataacgaacaccgacgaaattcaaataaaaaaaaaacgaaatcgaaaacgaccctaccgctacgataccgaaaataataataatacgaccgacgatacacgaataaaaaaaaaaccgaccgaaaaaattccgacgaaacgaataaaaaaattcgcgacgatatacgacgacttccgaacgaatccgaaaaataaataaaataaaaaactacgtcaccgtaccgaaaaaaaaaacgacaacgccgactaacgcacgaacacgacgaaaaaaactaccgaaaaaactccgacgaaacgaaaaacgaaaccgacgcgaacgacgacgttccgacgaaattcgaacgataccgtaacctaaccgaaaaaaaaaataacgctactataccgaaaaaaacaacgacgataaaaaacgacgctctaacaaaacgacacaaacgactaaaaataatacaataacgacaacgccactatacaccaacgaaaaaacgtctccgttaatccccgtacgaaacgaaaaacaaaccgacgtaaaaaaaacacctacgaaaccgaaaaaaataataacgacgtcaaccgccgcacgaaaaaaacgacacaaacgactaaaaaataaccgacgccgaaaaaaaaaaaaaaaaaaacgaaaaaaaataatacgaccacgaaaaaactcgaaaaaaaactaaaacgaaaaaacgaaacgaaaaaattccattttataaacaaaaaaaaaaaaccgaccacgaaaaaaacgaaaaacgacgacgaaaaactcgaccgacgaccataaaaaataaccgaaattaacgcgtccgttcctaacgatttaaaacgctattcaaaaaaaaaattaaaaacaattaaaaaaaaaaaaataaaaattaaaaccccctaa

SEQ ID NO: 40093 - DNA, 791 bp, Artificial Sequence
  chemically treated genomic DNA (Homo sapiens) CpG-island No: 40093
gttgttgttgtggttggttcggtttgcgatcggcgcgttacggttagtatcggcgggtcgcgcgtcggtggcggcggtgcgttcgttttgcggttggttttttgtttgtttcgcgtttgtgtcgtcgtttttttgttgggtcgcggggggggtggttgtgtgtggagtttggtagtggacgggttggcgtagtttgttacggtcgttcgggcgttttcggtcgtttttcgtttggcgcggcggtggtcgtttgttggttgtagcggggtcgttcgttcggcgcgtgttgtcggtgcgggtggtttgtggtggtttgttcgttcgtgcgtgttgtcgttttgttttttttgtgttggtcgtgtggttgttgcgttggtggtgtagtgggtgtgttcgtttttgtgtgtttcgtgtgggtgtgtttgcgtttggttgtttgttcgttacgggtaggtcgttttttttcggcggttcgcgggcgcggtttgtgttcggttttgttgtcggcgcggagtcgttcgggtggttgtgggggttcggtcggtgttttggttttcggttttttttgtgtttcgtttttagcgttgtgtcggcgcgtcgtcgtttgttgtggtttggatatgcgtggagagagttgagggattagtttagtgtcgcgttgaggtgtggttgtgtgatttttcgtgttatgatcgtgacgcggttttgtggtgtgtttggtgttgtgtttgttcggtcgagttttgtggtggtcgttttgtcgttcgtagggtatgtattttattttgttt

SEQ ID NO: 40094 - DNA, 791 bp, Artificial Sequence
  chemically treated genomic DNA (Homo sapiens) CpG-island No: 40094
aaacaaaataaaatacataccctacgaacgacaaaacgaccaccacaaaactcgaccgaacaaacacaacaccaaacacaccacaaaaccgcgtcacgatcataacacgaaaaatcacacaaccacacctcaacgcgacactaaactaatccctcaactctctccacgcatatccaaaccacaacaaacgacgacgcgccgacacaacgctaaaaacgaaacacaaaaaaaaccgaaaaccaaaacaccgaccgaacccccacaaccacccgaacgactccgcgccgacaacaaaaccgaacacaaaccgcgcccgcgaaccgccgaaaaaaaacgacctacccgtaacgaacaaacaaccaaacgcaaacacacccacacgaaacacacaaaaacgaacacacccactacaccaccaacgcaacaaccacacgaccaacacaaaaaaaacaaaacgacaacacgcacgaacgaacaaaccaccacaaaccacccgcaccgacaacacgcgccgaacgaacgaccccgctacaaccaacaaacgaccaccgccgcgccaaacgaaaaacgaccgaaaacgcccgaacgaccgtaacaaactacgccaacccgtccactaccaaactccacacacaaccaccccccccgcgacccaacaaaaaaacgacgacacaaacgcgaaacaaacaaaaaaccaaccgcaaaacgaacgcaccgccgccaccgacgcgcgacccgccgatactaaccgtaacgcgccgatcgcaaaccgaaccaaccacaacaacaac

SEQ ID NO: 40095 - DNA, 791 bp, Artificial Sequence
  chemically treated genomic DNA (Homo sapiens) CpG-island No: 40095
agataaagtagaatgtatattttacgaacgataaggcgattattataagattcgatcgaataaatataatattaaatatattataagatcgcgttacgattatagtacggagaattatatagttatattttagcgcgatattaaattagttttttagttttttttacgtatatttaggttatagtaaacgacggcgcgtcgatatagcgttgagaacggagtatagaaggaatcgagaattaagatatcggtcgagtttttatagttattcgaacgatttcgcgtcgataatagagtcggatataggtcgcgttcgcgagtcgtcgagggagagcgatttgttcgtaacgagtaaataattaagcgtagatatatttatacgagatatataagaacgagtatatttattgtattattaacgtaatagttatacgattaatataagaaagataagacgataatacgtacgaacgagtaaattattataaattattcgtatcggtagtacgcgtcgggcgagcgatttcgttataattagtagacgattatcgtcgcgttaagcgagaagcggtcggaggcgttcggacgatcgtagtaggttgcgttagttcgtttattattagattttatatataattatttttttcgcgatttaataaaaagacgacgatatagacgcggaataaatagggggttagtcgtaagacggacgtatcgtcgttatcggcgcgcggttcgtcggtgttgatcgtagcgcgtcgatcgtaagtcgaattaattatagtaataat

SEQ ID NO: 40096 - DNA, 791 bp, Artificial Sequence
  chemically treated genomic DNA (Homo sapiens) CpG-island No: 40096
attattactataattaattcgacttacgatcgacgcgctacgatcaacaccgacgaaccgcgcgccgataacgacgatacgtccgtcttacgactaaccccctatttattccgcgtctatatcgtcgtctttttattaaatcgcgaaaaaaataattatatataaaatctaataataaacgaactaacgcaacctactacgatcgtccgaacgcctccgaccgcttctcgcttaacgcgacgataatcgtctactaattataacgaaatcgctcgcccgacgcgtactaccgatacgaataatttataataatttactcgttcgtacgtattatcgtcttatctttcttatattaatcgtataactattacgttaataatacaataaatatactcgttcttatatatctcgtataaatatatctacgcttaattatttactcgttacgaacaaatcgctctccctcgacgactcgcgaacgcgacctatatccgactctattatcgacgcgaaatcgttcgaataactataaaaactcgaccgatatcttaattctcgattccttctatactccgttctcaacgctatatcgacgcgccgtcgtttactataacctaaatatacgtaaaaaaaactaaaaaactaatttaatatcgcgctaaaatataactatataattctccgtactataatcgtaacgcgatcttataatatatttaatattatatttattcgatcgaatcttataataatcgccttatcgttcgtaaaatatacattctactttatct

SEQ ID NO: 40097 - DNA, 842 bp, Artificial Sequence
  chemically treated genomic DNA (Homo sapiens) CpG-island No: 40097
cgttgttggcgtttttttataggtttcgtttttttgacgagtattataaaaatcgacgtttaagttagaggtggcgaaattcgataggattataaagatattaggcgtttttttttggaagttttttcgtgcgtttttttgtttcgattttgtcgtttatcggatatttgttcgttttttttttttcgggaagcgtggcgttttttttagtttacgttggaggtattttagttcggtgtaggtcgttcgttttaagttgggttgtgggtacgaatttttcgtttagttcgtcggtgtggtttattcggtaattttcggtttgagtttattcgggtaggatttattttttgttttgtggggggttatcggtatcgtcgttgcgttttttcgtttttgtcgtggttttcgatgttttgatggggtgcgcgttagcgcgtgtcggtgtattggtggttttttcgtattttgtgtgcggtgcgtttcgttcgaaattgagagtttttatttttcgttatatttttttcgattttgtggtttttttttttgtgtatttttttagatttaatatgtcgatggcgttttgtgagggtttcggttttacggcgtgatgttagtttcggtagtcggcgtcgtaatttgggattaagagacgcgaataataatacgggtgtcgggtggttttgtttcgcgcggttcgtttttgcgtcgcggtgtttgtatgggcggtgaatagggatgaggatgtgaggcgggatggggagtaggagagtaagggtgggtgtttagtaatgagcgtggggtgaaaaatattggcgataagcgacgggcggcggttgtggaat

SEQ ID NO: 40098 - DNA, 842 bp, Artificial Sequence
  chemically treated genomic DNA (Homo sapiens) CpG-island No: 40098
attccacaaccgccgcccgtcgcttatcgccaatatttttcaccccacgctcattactaaacacccacccttactctcctactccccatcccgcctcacatcctcatccctattcaccgcccatacaaacaccgcgacgcaaaaacgaaccgcgcgaaacaaaaccacccgacacccgtattattattcgcgtctcttaatcccaaattacgacgccgactaccgaaactaacatcacgccgtaaaaccgaaaccctcacaaaacgccatcgacatattaaatctaaaaaaatacacaaaaaaaaaaaccacaaaatcgaaaaaaatataacgaaaaataaaaactctcaatttcgaacgaaacgcaccgcacacaaaatacgaaaaaaccaccaatacaccgacacgcgctaacgcgcaccccatcaaaacatcgaaaaccacgacaaaaacgaaaaaacgcaacgacgataccgataaccccccacaaaacaaaaaataaatcctacccgaataaactcaaaccgaaaattaccgaataaaccacaccgacgaactaaacgaaaaattcgtacccacaacccaacttaaaacgaacgacctacaccgaactaaaatacctccaacgtaaactaaaaaaaacgccacgcttcccgaaaaaaaaaaaacgaacaaatatccgataaacgacaaaatcgaaacaaaaaaacgcacgaaaaaacttccaaaaaaaaacgcctaatatctttataatcctatcgaatttcgccacctctaacttaaacgtcgatttttataatactcgtcaaaaaaacgaaacctataaaaaaacgccaacaacg

SEQ ID NO: 40099 - DNA, 842 bp, Artificial Sequence
  chemically treated genomic DNA (Homo sapiens) CpG-island No: 40099
attttataatcgtcgttcgtcgtttgtcgttaatattttttattttacgtttattgttaaatatttatttttatttttttgttttttatttcgttttatatttttatttttatttatcgtttatataagtatcgcggcgtagaagcgggtcgcgcgggatagagttattcgatattcgtgttgttattcgcgttttttaattttaggttgcggcgtcgattatcgagattgatattacgtcgtaaagtcgaggtttttataaagcgttatcggtatattgggtttgaaaggatatataaagaaggaaattataaaatcggggggggtatgacgggaagtaggggtttttaatttcgagcgaaacgtatcgtatatagaatacggagaaattattagtatatcgatacgcgttagcgcgtattttattaagatatcgggggttacgatagaagcggaggaacgtaacgacggtatcggtggttttttataggataaaaagtaggttttattcgggtggatttaagtcgaaagttatcggataagttatatcggcgggttgaacggggggttcgtgtttatagtttagtttggagcgaacgatttatatcgaattgagatatttttagcgtgagttagagaaagcgttacgtttttcgaagggagaaaggcggataggtattcggtaagcggtagggtcggaataggagagcgtacgagggagtttttagggggaaacgtttggtatttttatagttttgtcgggtttcgttatttttgatttgagcgtcgatttttgtgatgttcgttaggggggcggagtttatggaaaaacgttagtaacg

SEQ ID NO: 40100 - DNA, 842 bp, Artificial Sequence
  chemically treated genomic DNA (Homo sapiens) CpG-island No: 40100
cgttactaacgtttttccataaactccgcccccctaacgaacatcacaaaaatcgacgctcaaatcaaaaataacgaaacccgacaaaactataaaaataccaaacgtttccccctaaaaactccctcgtacgctctcctattccgaccctaccgcttaccgaatacctatccgcctttctcccttcgaaaaacgtaacgctttctctaactcacgctaaaaatatctcaattcgatataaatcgttcgctccaaactaaactataaacacgaaccccccgttcaacccgccgatataacttatccgataactttcgacttaaatccacccgaataaaacctactttttatcctataaaaaaccaccgataccgtcgttacgttcctccgcttctatcgtaacccccgatatcttaataaaatacgcgctaacgcgtatcgatatactaataatttctccgtattctatatacgatacgtttcgctcgaaattaaaaacccctacttcccgtcataccccccccgattttataatttccttctttatatatcctttcaaacccaatataccgataacgctttataaaaacctcgactttacgacgtaatatcaatctcgataatcgacgccgcaacctaaaattaaaaaacgcgaataacaacacgaatatcgaataactctatcccgcgcgacccgcttctacgccgcgatacttatataaacgataaataaaaataaaaatataaaacgaaataaaaaacaaaaaaataaaaataaatatttaacaataaacgtaaaataaaaaatattaacgacaaacgacgaacgacgattataaaat

SEQ ID NO: 40101 - DNA, 1193 bp, Artificial Sequence
  chemically treated genomic DNA (Homo sapiens) CpG-island No: 40101
  misc_feature (73)..(73): n is either a, c, g or t
  misc_feature (104)..(104): n is either a, c, g or t
  misc_feature (907)..(907): n is either a, c, g or t
  misc_feature (944)..(944): n is either a, c, g or t
gcgacgtttagagtttatagcgtattttttatttttttatattcgtaagttatcgcgcggatgttttattgtnagcgtagcgcgtatagcgacgtaattgtttnttagtcgcgttcgatttttatgtttgacgttattttcgcgcgatttacggtttgtttattacgtacgtttgtgtcgatagcgttgtcgtcgtttggttcgcgcggagttcgtattcgttattcgttttgttttttttatatattttcgttttttacggtagattcgtttacgattatagcgagcgcgttagtttttttgtttttttttttgtatttttagcgcgatgtataacgcgcgtgagttcgtggtacggagtacgcgtttcgcgttacgtttttcggtcgttttttcgtcgtgtagtagtgtttagcgtgtcgttcgattgtatcgtttgaggatagtgtttttattagcgttgacgttcgttacgtggtttttttttcgtcgtatttgttcgcgcgtattttttatttttattttttagtcgtattatggttatattgttttttgtatagatatttgtgtgaatagtgcgttgttgttcgcgtggttttcgtcggttgttcgttagcggcgatagtttcgcgacgcggcgattatattataacgattttcgttaggttacgttgttatacggtaacgtcgtgtcgtaatattcgttcgttcgtatgtcgcgcgttcgcgcgttcgtagaatattgtcgcgtatcgttcgtatgcgtaggtaagttcgcgtcgttatatgtagttatcgcgtttcggagatttggttagttcgtatacgcgtattgaatttttttttacggttattattacgtcgttcgttatttgttcgcgttatttgtagcgatttttggttattntcgcggcggtttagtttcgtcgtttgtgttcgtttantttgtcgcgtatgcgtatcgttcgcgtaggcgcgttgtttagttatagttagtagacgtattacgatattttcgttcgtcgtttagattttacgtataggtttttttggatttggtgcgtaataggtaatacgcgtgcgtttggcgtgtagtatgagcgattttcgttgttgcgtatttgtgtagtttgcgtgggagcgttttatttcgttcgacgtgcgtcgttatttaaatgttgttttttacgtgt

SEQ ID NO: 40102 - DNA, 1193 bp, Artificial Sequence
  chemically treated genomic DNA (Homo sapiens) CpG-island No: 40102
  misc_feature (250)..(250): n is either a, c, g or t
  misc_feature (287)..(287): n is either a, c, g or t
  misc_feature (1090)..(1090): n is either a, c, g or t
  misc_feature (1121)..(1121): n is either a, c, g or t
acacgtaaaaaacaacatttaaataacgacgcacgtcgaacgaaataaaacgctcccacgcaaactacacaaatacgcaacaacgaaaatcgctcatactacacgccaaacgcacgcgtattacctattacgcaccaaatccaaaaaaacctatacgtaaaatctaaacgacgaacgaaaatatcgtaatacgtctactaactataactaaacaacgcgcctacgcgaacgatacgcatacgcgacaaantaaacgaacacaaacgacgaaactaaaccgccgcganaataaccaaaaatcgctacaaataacgcgaacaaataacgaacgacgtaataataaccgtaaaaaaaaattcaatacgcgtatacgaactaaccaaatctccgaaacgcgataactacatataacgacgcgaacttacctacgcatacgaacgatacgcgacaatattctacgaacgcgcgaacgcgcgacatacgaacgaacgaatattacgacacgacgttaccgtataacaacgtaacctaacgaaaatcgttataatataatcgccgcgtcgcgaaactatcgccgctaacgaacaaccgacgaaaaccacgcgaacaacaacgcactattcacacaaatatctatacaaaaaacaatataaccataatacgactaaaaaataaaaataaaaaatacgcgcgaacaaatacgacgaaaaaaaaaccacgtaacgaacgtcaacgctaataaaaacactatcctcaaacgatacaatcgaacgacacgctaaacactactacacgacgaaaaaacgaccgaaaaacgtaacgcgaaacgcgtactccgtaccacgaactcacgcgcgttatacatcgcgctaaaaatacaaaaaaaaaaacaaaaaaactaacgcgctcgctataatcgtaaacgaatctaccgtaaaaaacgaaaatatataaaaaaaacaaaacgaataacgaatacgaactccgcgcgaaccaaacgacgacaacgctatcgacacaaacgtacgtaataaacaaaccgtaaatcgcgcgaaaataacgtcaaacataaaaatcgaacgcgactaanaaacaattacgtcgctatacgcgctacgctnacaataaaacatccgcgcgataacttacgaatataaaaaaataaaaaatacgctataaactctaaacgtcgc

SEQ ID NO: 40103 - DNA, 1193 bp, Artificial Sequence
  chemically treated genomic DNA (Homo sapiens) CpG-island No: 40103
  misc_feature (250)..(250): n is either a, c, g or t
  misc_feature (287)..(287): n is either a, c, g or t
  misc_feature (1090)..(1090): n is either a, c, g or t
  misc_feature (1121)..(1121): n is either a, c, g or t
gtacgtgaggagtagtatttaggtggcgacgtacgtcgagcggagtgaggcgtttttacgtaggttgtataagtgcgtagtagcgagagtcgtttatattgtacgttaagcgtacgcgtattgtttgttgcgtattagatttaaggagatttatgcgtagagtttaagcgacgagcgagagtatcgtgatgcgtttattgattgtggttaggtagcgcgtttgcgcgagcgatgcgtatgcgcgatagantgagcgagtataggcgacgagattaggtcgtcgcgangatagttagagatcgttataggtggcgcggatagatagcgaacggcgtggtagtgatcgtagaggagagtttagtgcgcgtgtacgagttgattaagttttcgagacgcgatggttgtatgtggcgacgcggatttgtttgcgtatacggacgatgcgcggtagtattttgcgagcgcgcgagcgcgcgatatgcgagcgagcgagtgttgcggtacgacgttgtcgtatggtagcgtagtttgacgaggatcgttgtggtgtagtcgtcgcgtcgcgaagttgtcgtcgttggcgagtagtcggcgagagttacgcgagtaatagcgtattgtttatataggtgtttgtgtagaagatagtatggttatagtacggttgagagatagaagtaagagatgcgcgcgagtagatacgacgaggagaagattacgtggcgagcgttagcgttggtagagatattgtttttagacggtgtaatcgagcggtacgttggatattattgtacgacgagggggcgatcggaggacgtgacgcggagcgcgtgtttcgtgttacgagtttacgcgcgttgtgtatcgcgttagagatgtagaggaaagaatagagagattagcgcgttcgttgtgatcgtgagcgagtttgtcgtgagaggcgagagtgtgtgagaggagtaaagcgagtaacgagtacgggtttcgcgcgagttaggcgacggtaacgttatcgatatagacgtacgtgatggatagatcgtgggtcgcgcggaagtggcgttaggtatgggagtcgggcgcgattagngggtagttgcgtcgttgtgcgcgttgcgttngtagtgaggtattcgcgcgatggtttgcgggtatagagagatggagagtgcgttgtaggttttgggcgtcgt

SEQ ID NO: 40104 - DNA, 1193 bp, Artificial Sequence
  chemically treated genomic DNA (Homo sapiens) CpG-island No: 40104
  misc_feature (73)..(73): n is either a, c, g or t
  misc_feature (104)..(104): n is either a, c, g or t
  misc_feature (907)..(907): n is either a, c, g or t
  misc_feature (944)..(944): n is either a, c, g or t
acgacgcccaaaacctacaacgcactctccatctctctatacccgcaaaccatcgcgcgaatacctcactacnaacgcaacgcgcacaacgacgcaactacccnctaatcgcgcccgactcccatacctaacgccacttccgcgcgacccacgatctatccatcacgtacgtctatatcgataacgttaccgtcgcctaactcgcgcgaaacccgtactcgttactcgctttactcctctcacacactctcgcctctcacgacaaactcgctcacgatcacaacgaacgcgctaatctctctattctttcctctacatctctaacgcgatacacaacgcgcgtaaactcgtaacacgaaacacgcgctccgcgtcacgtcctccgatcgccccctcgtcgtacaataatatccaacgtaccgctcgattacaccgtctaaaaacaatatctctaccaacgctaacgctcgccacgtaatcttctcctcgtcgtatctactcgcgcgcatctcttacttctatctctcaaccgtactataaccatactatcttctacacaaacacctatataaacaatacgctattactcgcgtaactctcgccgactactcgccaacgacgacaacttcgcgacgcgacgactacaccacaacgatcctcgtcaaactacgctaccatacgacaacgtcgtaccgcaacactcgctcgctcgcatatcgcgcgctcgcgcgctcgcaaaatactaccgcgcatcgtccgtatacgcaaacaaatccgcgtcgccacatacaaccatcgcgtctcgaaaacttaatcaactcgtacacgcgcactaaactctcctctacgatcactaccacgccgttcgctatctatccgcgccacctataacgatctctaactatcntcgcgacgacctaatctcgtcgcctatactcgctcantctatcgcgcatacgcatcgctcgcgcaaacgcgctacctaaccacaatcaataaacgcatcacgatactctcgctcgtcgcttaaactctacgcataaatctccttaaatctaatacgcaacaaacaatacgcgtacgcttaacgtacaatataaacgactctcgctactacgcacttatacaacctacgtaaaaacgcctcactccgctcgacgtacgtcgccacctaaatactactcctcacgtac

SEQ ID NO: 40105 - DNA, 518 bp, Artificial Sequence
  chemically treated genomic DNA (Homo sapiens) CpG-island No: 40105
gttagtgtcgcggtcgcggtcgtcgtcgacgtcgtcgtcgtcgtcgtttgggcggttgcgtttatatttatcggtcgtggacgcgcggcggttcgttggagcgttcgtagtcgcgtaaggattcgttggacgatagcggtagttgtttgagcggtagttagcggattttgttttcggtttcgtcgagttcgggttatttgggtcgcggcgcgttatcgttagtcgagttgtgcgtttttttcgagtggaaggcgttcggcgtttttttgagtttgttcgcgtttgagtttttcggtcgtcgcggtcgttacgattcgggttcgttttttatttttaagtttttgatcgagttcgagagtttcgggatcgacggcggcgttagtaacgggaggttgcgaggtcgcggtcgacgtggttaacgggtagtcgggttttaaaagtaatatgtttttggcgttcgggtagttttagggttttcgtgcgtagttttttttttttggggaggaaaatatcgtggg

SEQ ID NO: 40106 - DNA, 518 bp, Artificial Sequence
  chemically treated genomic DNA (Homo sapiens) CpG-island No: 40106
cccacgatattttcctccccaaaaaaaaaaaactacgcacgaaaaccctaaaactacccgaacgccaaaaacatattacttttaaaacccgactacccgttaaccacgtcgaccgcgacctcgcaacctcccgttactaacgccgccgtcgatcccgaaactctcgaactcgatcaaaaacttaaaaataaaaaacgaacccgaatcgtaacgaccgcgacgaccgaaaaactcaaacgcgaacaaactcaaaaaaacgccgaacgccttccactcgaaaaaaacgcacaactcgactaacgataacgcgccgcgacccaaataacccgaactcgacgaaaccgaaaacaaaatccgctaactaccgctcaaacaactaccgctatcgtccaacgaatccttacgcgactacgaacgctccaacgaaccgccgcgcgtccacgaccgataaatataaacgcaaccgcccaaacgacgacgacgacgacgtcgacgacgaccgcgaccgcgacactaac

SEQ ID NO: 40107 - DNA, 518 bp, Artificial Sequence
  chemically treated genomic DNA (Homo sapiens) CpG-island No: 40107
tttacgatgtttttttttttagggaaagaaagttgcgtacgggggttttaaaattgttcgggcgttaggggtatgttgtttttgaagttcggttgttcgttggttacgtcggtcgcggtttcgtagtttttcgttgttggcgtcgtcgtcggtttcggggttttcgggttcggttaggagtttgaaggtgaagagcgggttcgagtcgtggcggtcgcggcggtcggggggtttaggcgcgggtaggtttaggagggcgtcgggcgttttttattcggggaaggcgtatagttcgattggcggtggcgcgtcgcggtttaggtagttcgggttcggcgaggtcgagggtagggttcgttggttgtcgtttaggtagttgtcgttgtcgtttagcgagtttttgcgcgattgcgagcgttttagcgagtcgtcgcgcgtttacggtcggtaggtgtaggcgtagtcgtttaggcgacggcggcggcggcgtcggcggcggtcgcggtcgcggtattggt

SEQ ID NO: 40108 - DNA, 518 bp, Artificial Sequence
  chemically treated genomic DNA (Homo sapiens) CpG-island No: 40108
accaataccgcgaccgcgaccgccgccgacgccgccgccgccgtcgcctaaacgactacgcctacacctaccgaccgtaaacgcgcgacgactcgctaaaacgctcgcaatcgcgcaaaaactcgctaaacgacaacgacaactacctaaacgacaaccaacgaaccctaccctcgacctcgccgaacccgaactacctaaaccgcgacgcgccaccgccaatcgaactatacgccttccccgaataaaaaacgcccgacgccctcctaaacctacccgcgcctaaaccccccgaccgccgcgaccgccacgactcgaacccgctcttcaccttcaaactcctaaccgaacccgaaaaccccgaaaccgacgacgacgccaacaacgaaaaactacgaaaccgcgaccgacgtaaccaacgaacaaccgaacttcaaaaacaacatacccctaacgcccgaacaattttaaaacccccgtacgcaactttctttccctaaaaaaaaaaacatcgtaaa

SEQ ID NO: 40109 - DNA, 540 bp, Artificial Sequence
  chemically treated genomic DNA (Homo sapiens) CpG-island No: 40109
ataagtgcgcgtagtgattaggttcgatttttagagaggtcgttgggaattgtaggagatcgcggcgcgagcgtagaacgggttttgggtggaggaggggacgagcggagaggggcgcgggattcgcgggagggagcggagggggcgtaggcggacggttttgcgaacggagaaggggtgaggcgcggaggaaaaggttggatttcgcgttcgttatttattcgtggacgtttcgtttgggtcgttatggtttaagagcgcgttttttcgcgggtcggcgtatcgcgcggttattttcggcgtttttggtttcgtttcggcgtcggaattacgtggtgtttgttttgtcgtttacgttgtagattggtcggagttatcgcgggttggaatcgttttttatgaaaatattttgagtttaggatttttaattgtatttacgcgttgcgagtgtagaaggagagtttcgtgtcgtttggcgtttggttgtgagttaggtatagttttggttttcggtttgttttcgagggttgaggttttttg

SEQ ID NO: 40110 - DNA, 540 bp, Artificial Sequence
  chemically treated genomic DNA (Homo sapiens) CpG-island No: 40110
caaaaaacctcaaccctcgaaaacaaaccgaaaaccaaaactatacctaactcacaaccaaacgccaaacgacacgaaactctccttctacactcgcaacgcgtaaatacaattaaaaatcctaaactcaaaatattttcataaaaaacgattccaacccgcgataactccgaccaatctacaacgtaaacgacaaaacaaacaccacgtaattccgacgccgaaacgaaaccaaaaacgccgaaaataaccgcgcgatacgccgacccgcgaaaaaacgcgctcttaaaccataacgacccaaacgaaacgtccacgaataaataacgaacgcgaaatccaaccttttcctccgcgcctcaccccttctccgttcgcaaaaccgtccgcctacgccccctccgctccctcccgcgaatcccgcgcccctctccgctcgtcccctcctccacccaaaacccgttctacgctcgcgccgcgatctcctacaattcccaacgacctctctaaaaatcgaacctaatcactacgcgcacttat

SEQ ID NO: 40111 - DNA, 540 bp, Artificial Sequence
  chemically treated genomic DNA (Homo sapiens) CpG-island No: 40111
taagaagttttagttttcggggatagatcgaaggttagggttgtatttggtttataattaggcgttaagcggtacgggattttttttttgtattcgtagcgcgtgagtgtaattggagattttggatttaagatgtttttatgaggaacgattttagttcgcggtaatttcggttagtttgtagcgtggacgataaaataggtattacgtggtttcggcgtcggggcggggttagagacgtcggaagtgatcgcgcggtgcgtcggttcgcgaggaaacgcgtttttagattatggcgatttaggcgaagcgtttacgggtgagtggcgggcgcggggtttagttttttttttcgcgttttatttttttttcgttcgtagaatcgttcgtttgcgtttttttcgttttttttcgcgggtttcgcgttttttttcgttcgtttttttttttatttaaagttcgttttgcgttcgcgtcgcggttttttgtagtttttagcggtttttttgggggtcggatttggttattgcgcgtatttat

SEQ ID NO: 40112 - DNA, 540 bp, Artificial Sequence
  chemically treated genomic DNA (Homo sapiens) CpG-island No: 40112
ataaatacgcgcaataaccaaatccgacccccaaaaaaaccgctaaaaactacaaaaaaccgcgacgcgaacgcaaaacgaactttaaataaaaaaaaaaacgaacgaaaaaaaacgcgaaacccgcgaaaaaaaacgaaaaaaacgcaaacgaacgattctacgaacgaaaaaaaaataaaacgcgaaaaaaaaaactaaaccccgcgcccgccactcacccgtaaacgcttcgcctaaatcgccataatctaaaaacgcgtttcctcgcgaaccgacgcaccgcgcgatcacttccgacgtctctaaccccgccccgacgccgaaaccacgtaatacctattttatcgtccacgctacaaactaaccgaaattaccgcgaactaaaatcgttcctcataaaaacatcttaaatccaaaatctccaattacactcacgcgctacgaatacaaaaaaaaaatcccgtaccgcttaacgcctaattataaaccaaatacaaccctaaccttcgatctatccccgaaaactaaaacttctta

SEQ ID NO: 40113 - DNA, 1090 bp, Artificial Sequence
  chemically treated genomic DNA (Homo sapiens) CpG-island No: 40113
tttcgtggttgggggaattgcggttcgtttcggtaaagcggggattcgagtttttgtcgtcggttcgtaggagtttcgggttcgatgttttgttaatttgtttggggtgttcgtttttcgttttgcgaggtggggttaggttaagacgaggaggagttcgcgtaagcgtatttattattacggcggtgatcggttggttcgggatgtaggatatttcgattttgttttggtcgtttagcgtcgtttcgagaagtcggtagtagagtattcgcggtcgcgttttcgttgtttaataaaggtcgtttcgttcggttcgtttttttatgaatagttaataaatttttagttaattattggtcggagcgttatttcgttttcggaagtttttgcgcgtgcgtagaaaagcgggtagagggcggagcgtgttcggggcgtttacggcgtaggcgcggagggcggggcgggatttgggcgcgtgcgtagttcgagatttttcggtagtttttcgagtaagatggcgtcgcgggtattttttttattgttcgtttgagggaacgttaagtagtgtgttcggcgtcgtgttttaggtaattgggttatcgtggtcggggaacgtagacgcgttattatttttcggtcggttcggatttttaattttttcggcgtttttggaagattcgaggtttaggattggtgttaggtttcggaagttttagggggagggggcggcgtgaatttaatttatcgagtttcgggcgttatttgtaatttggtttttttcgtagtttcgcgttgtttcgcgagaaagcgagaggtcgagttcgggttggtgcgatggtcgcggtggtggttaagcgggaagggtcgtcgtttattagcgaggcggtcgtgcggggtaacgtcgtcgttttggattattgtcggatttcggtgttagcgttgtcgggggttacggtcggtattttcggttttatcggtttttacggttttattttttatttgttcgttttcgttttgttttttttgttttttatttttaaggcgggaaggaggtggaataaatattttaaattacggagattttttttta

SEQ ID NO: 40114 - DNA, 1090 bp, Artificial Sequence
  chemically treated genomic DNA (Homo sapiens) CpG-island No: 40114
taaaaaaaaatctccgtaatttaaaatatttattccacctccttcccgccttaaaaataaaaaacaaaaaaaacaaaacgaaaacgaacaaataaaaaataaaaccgtaaaaaccgataaaaccgaaaataccgaccgtaacccccgacaacgctaacaccgaaatccgacaataatccaaaacgacgacgttaccccgcacgaccgcctcgctaataaacgacgacccttcccgcttaaccaccaccgcgaccatcgcaccaacccgaactcgacctctcgctttctcgcgaaacaacgcgaaactacgaaaaaaaccaaattacaaataacgcccgaaactcgataaattaaattcacgccgccccctccccctaaaacttccgaaacctaacaccaatcctaaacctcgaatcttccaaaaacgccgaaaaaattaaaaatccgaaccgaccgaaaaataataacgcgtctacgttccccgaccacgataacccaattacctaaaacacgacgccgaacacactacttaacgttccctcaaacgaacaataaaaaaaatacccgcgacgccatcttactcgaaaaactaccgaaaaatctcgaactacgcacgcgcccaaatcccgccccgccctccgcgcctacgccgtaaacgccccgaacacgctccgccctctacccgcttttctacgcacgcgcaaaaacttccgaaaacgaaataacgctccgaccaataattaactaaaaatttattaactattcataaaaaaacgaaccgaacgaaacgacctttattaaacaacgaaaacgcgaccgcgaatactctactaccgacttctcgaaacgacgctaaacgaccaaaacaaaatcgaaatatcctacatcccgaaccaaccgatcaccgccgtaataataaatacgcttacgcgaactcctcctcgtcttaacctaaccccacctcgcaaaacgaaaaacgaacaccccaaacaaattaacaaaacatcgaacccgaaactcctacgaaccgacgacaaaaactcgaatccccgctttaccgaaacgaaccgcaattcccccaaccacgaaa

SEQ ID NO: 40115 - DNA, 1090 bp, Artificial Sequence
  chemically treated genomic DNA (Homo sapiens) CpG-island No: 40115
taaagagaggttttcgtgatttgaaatatttgttttatttttttttcgttttgagaatgaggagtagggagagtaggacggaggcgagtaggtagaagatgaagtcgtagaggtcggtgaggtcgaggatgtcggtcgtggttttcgatagcgttgatatcgaggttcggtaataatttaggacggcggcgttgtttcgtacggtcgtttcgttgatgaacggcggtttttttcgtttggttattatcgcggttatcgtattagttcgggttcggtttttcgttttttcgcggaataacgcggagttgcggagaaaattaagttataagtggcgttcggagttcggtgagttgggtttacgtcgttttttttttttggagttttcgagatttggtattagttttgggtttcggattttttaaagacgtcgaggagattgagggttcgggtcggtcgggaggtggtggcgcgtttgcgtttttcggttacggtggtttagttatttggaatacggcgtcggatatattatttagcgtttttttagacgggtagtggaagaaatgttcgcggcgttattttgttcggaagattgtcgggaggtttcgggttgcgtacgcgtttagatttcgtttcgtttttcgcgtttgcgtcgtgggcgtttcggatacgtttcgttttttgttcgtttttttgcgtacgcgtagggattttcgaaagcggagtggcgtttcggttagtgattggttggaggtttgttaattatttatgagggggcgggtcgagcggggcggtttttgttaagtagcgagggcgcgatcgcgggtattttgttgtcggtttttcggagcggcgttgggcgattagagtagggtcgagatgttttatatttcgggttagtcggttatcgtcgtggtggtgagtgcgtttgcgcgggttttttttcgttttggtttgattttatttcgtagagcgggaaacggatattttaagtaggttgatagagtatcgaattcggggtttttgcgaatcggcggtaagggttcgggttttcgttttgtcggagcgggtcgtagtttttttagttacgaaa

SEQ ID NO: 40116 - DNA, 1090 bp, Artificial Sequence
  chemically treated genomic DNA (Homo sapiens) CpG-island No: 40116
tttcgtaactaaaaaaactacgacccgctccgacaaaacgaaaacccgaacccttaccgccgattcgcaaaaaccccgaattcgatactctatcaacctacttaaaatatccgtttcccgctctacgaaataaaatcaaaccaaaacgaaaaaaaacccgcgcaaacgcactcaccaccacgacgataaccgactaacccgaaatataaaacatctcgaccctactctaatcgcccaacgccgctccgaaaaaccgacaacaaaatacccgcgatcgcgccctcgctacttaacaaaaaccgccccgctcgacccgccccctcataaataattaacaaacctccaaccaatcactaaccgaaacgccactccgctttcgaaaatccctacgcgtacgcaaaaaaacgaacaaaaaacgaaacgtatccgaaacgcccacgacgcaaacgcgaaaaacgaaacgaaatctaaacgcgtacgcaacccgaaacctcccgacaatcttccgaacaaaataacgccgcgaacatttcttccactacccgtctaaaaaaacgctaaataatatatccgacgccgtattccaaataactaaaccaccgtaaccgaaaaacgcaaacgcgccaccacctcccgaccgacccgaaccctcaatctcctcgacgtctttaaaaaatccgaaacccaaaactaataccaaatctcgaaaactccaaaaaaaaaaaacgacgtaaacccaactcaccgaactccgaacgccacttataacttaattttctccgcaactccgcgttattccgcgaaaaaacgaaaaaccgaacccgaactaatacgataaccgcgataataaccaaacgaaaaaaaccgccgttcatcaacgaaacgaccgtacgaaacaacgccgccgtcctaaattattaccgaacctcgatatcaacgctatcgaaaaccacgaccgacatcctcgacctcaccgacctctacgacttcatcttctacctactcgcctccgtcctactctccctactcctcattctcaaaacgaaaaaaaaataaaacaaatatttcaaatcacgaaaacctctcttta

SEQ ID NO: 40117 - DNA, 695 bp, Artificial Sequence
  chemically treated genomic DNA (Homo sapiens) CpG-island No: 40117
gaggtcgtttacgaaattgtcgttttttttatttaggaagcgtttttagtcgtcggtcgtttttatttagttttgttcgggggatcgttagttttgttcgaggaatggtatggtatcgcgagcggattagacggatggggagacggggtcggtttggtgggttcggggacgtgttattcggggcggatgttcggggtgtaggggttcgcgacgggggcggcggggcggcgggaacggcgcggggtattttgcggggtggcgggcgcggagaggattttaagcgttgtaggtttcgggagtgttgcgcggtagtagttgtcgtagtatttattttcgtagtcggtcgtagttttttgttgtcggaagagtcgttcgtttttagttcggtttttcggttcggaggttacgtggttttgtttatgggttcggtttgtttttcgaggcgtttgcggtttacgtttttttttcggttgtataatcgcgtcggtggaaatttgaagcggtgttgtcgggtcgggtatttcgtcgtttttggtattttcgcgcgtttttttcgtttttaggatatcgttgttttagagcgaggttcggcgtttggaaagatgcgtttcggttttttgtagttttcgggttgacggggtgtagggagggggtcggaggggcgtttgggtttttgcggggtgggcgtgaggagt

SEQ ID NO: 40118 - DNA, 695 bp, Artificial Sequence
  chemically treated genomic DNA (Homo sapiens) CpG-island No: 40118
actcctcacgcccaccccgcaaaaacccaaacgcccctccgaccccctccctacaccccgtcaacccgaaaactacaaaaaaccgaaacgcatctttccaaacgccgaacctcgctctaaaacaacgatatcctaaaaacgaaaaaaacgcgcgaaaataccaaaaacgacgaaatacccgacccgacaacaccgcttcaaatttccaccgacgcgattatacaaccgaaaaaaaaacgtaaaccgcaaacgcctcgaaaaacaaaccgaacccataaacaaaaccacgtaacctccgaaccgaaaaaccgaactaaaaacgaacgactcttccgacaacaaaaaactacgaccgactacgaaaataaatactacgacaactactaccgcgcaacactcccgaaacctacaacgcttaaaatcctctccgcgcccgccaccccgcaaaataccccgcgccgttcccgccgccccgccgcccccgtcgcgaacccctacaccccgaacatccgccccgaataacacgtccccgaacccaccaaaccgaccccgtctccccatccgtctaatccgctcgcgataccataccattcctcgaacaaaactaacgatcccccgaacaaaactaaataaaaacgaccgacgactaaaaacgcttcctaaataaaaaaaacgacaatttcgtaaacgacctc

SEQ ID NO: 40119 - DNA, 695 bp, Artificial Sequence
  chemically treated genomic DNA (Homo sapiens) CpG-island No: 40119
gttttttacgtttatttcgtagggatttagacgttttttcggttttttttttgtatttcgttagttcgggagttgtaggagatcggggcgtatttttttaagcgtcgggtttcgttttgggataacggtgttttgggggcggggagggcgcgcggaggtgttaggggcggcggggtattcggttcggtagtatcgttttaagtttttatcggcgcggttgtgtaatcgggaggggagcgtgagtcgtaggcgtttcggaaaataagtcgagtttataaataaagttacgtggttttcgggtcggggggtcgggttaagagcgggcggttttttcggtaataaagagttgcggtcggttgcggggataaatattgcggtagttattgtcgcgtagtattttcggagtttgtaacgtttgagatttttttcgcgttcgttatttcgtagggtgtttcgcgtcgttttcgtcgtttcgtcgttttcgtcgcgggtttttgtatttcgagtattcgtttcgggtggtacgttttcgagtttattaggtcggtttcgtttttttattcgtttagttcgttcgcggtgttatgttatttttcgggtaggattggcggtttttcgggtagaattgggtgaagacggtcgacggttggaagcgttttttggatgagaagagcggtagtttcgtgagcgatttt

SEQ ID NO: 40120 - DNA, 695 bp, Artificial Sequence
  chemically treated genomic DNA (Homo sapiens) CpG-island No: 40120
aaaatcgctcacgaaactaccgctcttctcatccaaaaaacgcttccaaccgtcgaccgtcttcacccaattctacccgaaaaaccgccaatcctacccgaaaaataacataacaccgcgaacgaactaaacgaataaaaaaacgaaaccgacctaataaactcgaaaacgtaccacccgaaacgaatactcgaaatacaaaaacccgcgacgaaaacgacgaaacgacgaaaacgacgcgaaacaccctacgaaataacgaacgcgaaaaaaatctcaaacgttacaaactccgaaaatactacgcgacaataactaccgcaatatttatccccgcaaccgaccgcaactctttattaccgaaaaaaccgcccgctcttaacccgaccccccgacccgaaaaccacgtaactttatttataaactcgacttattttccgaaacgcctacgactcacgctcccctcccgattacacaaccgcgccgataaaaacttaaaacgatactaccgaaccgaataccccgccgcccctaacacctccgcgcgccctccccgcccccaaaacaccgttatcccaaaacgaaacccgacgcttaaaaaaatacgccccgatctcctacaactcccgaactaacgaaatacaaaaaaaaaaccgaaaaaacgtctaaatccctacgaaataaacgtaaaaaac

SEQ ID NO: 40121 - DNA, 518 bp, Artificial Sequence
  chemically treated genomic DNA (Homo sapiens) CpG-island No: 40121
gatcggtgttcgtagttttcgttttttcggtcgtcgtttttacggggcggggttttggttcgggattagcgtcgcggttataaatgggttgcggcgaggtcggtagaacgttgtgatagttatacgttttaaggtttttaagatgagttatacgttggattcgttgggtaattcgttcgtttatcggcgggtaatcgagattcgttcgagttttagtcgcgttagcggtttttcgtttagtggttttcgttcgtagtcgtggtttcgcggttcgtttagtatcgtgttttttttttataagcgtagtatgttcgtttcgcgtttcgtttatagttcggttatgtttagtttcgtcgagagtagttttgattttagttagttttcgtttttgtttaacggcggtttcggattcggcggcgattataagttgtttcgttttaacgagaaggagtagttgtaggggttgaacgatcgttttgtcggttatatagagaaggtgtattatttggagtagtaga

SEQ ID NO: 40122 - DNA, 518 bp, Artificial Sequence
  chemically treated genomic DNA (Homo sapiens) CpG-island No: 40122
tctactactccaaataatacaccttctctatataaccgacaaaacgatcgttcaacccctacaactactccttctcgttaaaacgaaacaacttataatcgccgccgaatccgaaaccgccgttaaacaaaaacgaaaactaactaaaatcaaaactactctcgacgaaactaaacataaccgaactataaacgaaacgcgaaacgaacatactacgcttataaaaaaaaaacacgatactaaacgaaccgcgaaaccacgactacgaacgaaaaccactaaacgaaaaaccgctaacgcgactaaaactcgaacgaatctcgattacccgccgataaacgaacgaattacccaacgaatccaacgtataactcatcttaaaaaccttaaaacgtataactatcacaacgttctaccgacctcgccgcaacccatttataaccgcgacgctaatcccgaaccaaaaccccgccccgtaaaaacgacgaccgaaaaaacgaaaactacgaacaccgatc

SEQ ID NO: 40123 - DNA, 518 bp, Artificial Sequence
  chemically treated genomic DNA (Homo sapiens) CpG-island No: 40123
tttgttgttttaggtagtgtattttttttatgtagtcggtaaagcggtcgtttagtttttgtagttgttttttttcgttggagcgggatagtttgtagtcgtcgtcgggttcggagtcgtcgttgagtagggacgaggattggttgaagttaaggttgttttcggcggagttgagtatggtcgagttgtaagcgaggcgcggggcgagtatgttgcgtttataggaggaggatacggtgttgggcgagtcgcgggattacgattgcgagcggaagttattggacggggagtcgttgacgcggttgaagttcgagcgggtttcggttattcgtcggtaggcggacgggttgtttagcgagtttaacgtgtagtttattttggaggttttggggcgtgtggttgttatagcgttttgtcggtttcgtcgtagtttatttatagtcgcggcgttggtttcgggttagggtttcgtttcgtggaggcggcggtcgaggaggcggggattgcgggtatcggtt

SEQ ID NO: 40124 - DNA, 518 bp, Artificial Sequence
  chemically treated genomic DNA (Homo sapiens) CpG-island No: 40124
aaccgatacccgcaatccccgcctcctcgaccgccgcctccacgaaacgaaaccctaacccgaaaccaacgccgcgactataaataaactacgacgaaaccgacaaaacgctataacaaccacacgccccaaaacctccaaaataaactacacgttaaactcgctaaacaacccgtccgcctaccgacgaataaccgaaacccgctcgaacttcaaccgcgtcaacgactccccgtccaataacttccgctcgcaatcgtaatcccgcgactcgcccaacaccgtatcctcctcctataaacgcaacatactcgccccgcgcctcgcttacaactcgaccatactcaactccgccgaaaacaaccttaacttcaaccaatcctcgtccctactcaacgacgactccgaacccgacgacgactacaaactatcccgctccaacgaaaaaaaacaactacaaaaactaaacgaccgctttaccgactacataaaaaaaatacactacctaaaacaacaaa

SEQ ID NO: 40125 - DNA, 538 bp, Artificial Sequence
  chemically treated genomic DNA (Homo sapiens) CpG-island No: 40125
ggtggagcgtaaagattatttgaagatagatatttcgacggcgttgaaggaaattcgtttttagttcgaaagttatttagattagaatatgtattaggtcgaagagtggtttaaatgtcgttacgttaagtttatcgaggcggtcgagtagaataaggaggttattcgtttcgttaaggaagagatcgtcgagtatcggcgttagttgtagtttaagagtatcgagttagagtcggtgcgcggtattaaggagtttttggagcggtagtttagcgatatcgaggagcgttataattacgattttagtagttattaggtaggaatcgcggttgcgcggttagtttgcgttagcgttagcgtcgcgcgttttcgatatttgggttcgtgtttaggcgtttttttcgtcgcgttttttggtggtcgttcgttagagtacgcgcgtcgtagatttagggtatttgcggattagcgttttcgtttattttattttttatatttcgtttttatttatttgttttagttgttaagggttttgatt

SEQ ID NO: 40126 - DNA, 538 bp, Artificial Sequence
  chemically treated genomic DNA (Homo sapiens) CpG-island No: 40126
aatcaaaacccttaacaactaaaacaaataaataaaaacgaaatataaaaaataaaataaacgaaaacgctaatccgcaaataccctaaatctacgacgcgcgtactctaacgaacgaccaccaaaaaacgcgacgaaaaaaacgcctaaacacgaacccaaatatcgaaaacgcgcgacgctaacgctaacgcaaactaaccgcgcaaccgcgattcctacctaataactactaaaatcgtaattataacgctcctcgatatcgctaaactaccgctccaaaaactccttaataccgcgcaccgactctaactcgatactcttaaactacaactaacgccgatactcgacgatctcttccttaacgaaacgaataacctccttattctactcgaccgcctcgataaacttaacgtaacgacatttaaaccactcttcgacctaatacatattctaatctaaataactttcgaactaaaaacgaatttccttcaacgccgtcgaaatatctatcttcaaataatctttacgctccacc

SEQ ID NO: 40127 - DNA, 538 bp, Artificial Sequence
  chemically treated genomic DNA (Homo sapiens) CpG-island No: 40127
ggttaagatttttagtagttggggtaggtgggtgggggcggagtgtggaggatgagatgggcgaggacgttgattcgtaaatattttaggtttgcggcgcgcgtgttttagcgagcggttattagggagcgcggcggagagggcgtttgggtacgagtttaagtgtcgggggcgcgcggcgttggcgttggcgtaggttggtcgcgtagtcgcggtttttatttggtagttgttgaggtcgtggttgtggcgtttttcgatgtcgttgagttgtcgttttagggattttttggtgtcgcgtatcgattttagttcgatgtttttggattgtagttggcgtcggtattcggcgattttttttttggcggagcggatggtttttttgttttgttcggtcgtttcggtgagtttggcgtagcggtatttgaattatttttcggtttggtgtatattttggtttgagtggttttcgagttgggagcggattttttttagcgtcgtcgagatgtttgtttttaggtagtttttgcgttttatt

SEQ ID NO: 40128 - DNA, 538 bp, Artificial Sequence
  chemically treated genomic DNA (Homo sapiens) CpG-island No: 40128
aataaaacgcaaaaactacctaaaaacaaacatctcgacgacgctaaaaaaaatccgctcccaactcgaaaaccactcaaaccaaaatatacaccaaaccgaaaaataattcaaataccgctacgccaaactcaccgaaacgaccgaacaaaacaaaaaaaccatccgctccgccaaaaaaaaaatcgccgaataccgacgccaactacaatccaaaaacatcgaactaaaatcgatacgcgacaccaaaaaatccctaaaacgacaactcaacgacatcgaaaaacgccacaaccacgacctcaacaactaccaaataaaaaccgcgactacgcgaccaacctacgccaacgccaacgccgcgcgcccccgacacttaaactcgtacccaaacgccctctccgccgcgctccctaataaccgctcgctaaaacacgcgcgccgcaaacctaaaatatttacgaatcaacgtcctcgcccatctcatcctccacactccgcccccacccacctaccccaactactaaaaatcttaacc

SEQ ID NO: 40129 - DNA, 681 bp, Artificial Sequence
  chemically treated genomic DNA (Homo sapiens) CpG-island No: 40129
gcggcgcgggagggtaggtgggagattggaggcgttttcgcgttttttagttattcgggagtttcgcgtcggcgatttcgattttgtcgaattcggcggaatatttagaaagaagttgagcgtttcgtagcggttaggatagcgggttaggttcgcgcgttttcgtagcgtacggttagacgcgacgttttttagtacggaatttagtttcgcggattatttcgaagtttagagttatatttcgcgtagaggatcgcggcgatcggaaaagtaaggtagaggcggaaaattatcgcgaggtttcgtttttcgtttcgcgtttgcgtttgcggttgtatcggggttggtcgggtcgcggtggggcggggtcgtttaggcgttttggacgcggagtcgtgggacgagggcggcggtgagttcgaggtggtagagtgattggggcgagcgtgttgtggtttttttttgcgttgttttagggtgtttttcgttcgtcgggattgagtttcgcgtcggcgtggtttgttgggttttaagcgttaggagtcggcgtagtcgtttttagttttggggacgggatcgagaagcggggtgtgggttttacgggattgttttttttgatttcgggtagcgttggggcgagagagggtaggcggaggttcgcggggattattagtattttcg

SEQ ID NO: 40130 - DNA, 681 bp, Artificial Sequence
  chemically treated genomic DNA (Homo sapiens) CpG-island No: 40130
cgaaaatactaataatccccgcgaacctccgcctaccctctctcgccccaacgctacccgaaatcaaaaaaaacaatcccgtaaaacccacaccccgcttctcgatcccgtccccaaaactaaaaacgactacgccgactcctaacgcttaaaacccaacaaaccacgccgacgcgaaactcaatcccgacgaacgaaaaacaccctaaaacaacgcaaaaaaaaaccacaacacgctcgccccaatcactctaccacctcgaactcaccgccgccctcgtcccacgactccgcgtccaaaacgcctaaacgaccccgccccaccgcgacccgaccaaccccgatacaaccgcaaacgcaaacgcgaaacgaaaaacgaaacctcgcgataattttccgcctctaccttacttttccgatcgccgcgatcctctacgcgaaatataactctaaacttcgaaataatccgcgaaactaaattccgtactaaaaaacgtcgcgtctaaccgtacgctacgaaaacgcgcgaacctaacccgctatcctaaccgctacgaaacgctcaacttctttctaaatattccgccgaattcgacaaaatcgaaatcgccgacgcgaaactcccgaataactaaaaaacgcgaaaacgcctccaatctcccacctaccctcccgcgccgc

SEQ ID NO: 40131 - DNA, 681 bp, Artificial Sequence
  chemically treated genomic DNA (Homo sapiens) CpG-island No: 40131
cggggatgttggtggttttcgcgagttttcgtttgttttttttcgttttagcgttgttcgaggttaggggggatagtttcgtgaggtttatatttcgtttttcggtttcgtttttaaagttgagagcggttgcgtcgatttttggcgtttggaatttagtaggttacgtcggcgcggaatttagtttcggcgagcgggaggtattttgaggtagcgtagggaagggttatagtacgttcgttttagttattttgttatttcgaatttatcgtcgttttcgttttacggtttcgcgtttaaggcgtttgagcggtttcgttttatcgcggttcggttaatttcggtgtagtcgtagacgtaggcgcggagcgggaggcgggatttcgcggtggtttttcgtttttgttttgttttttcggtcgtcgcggttttttgcgcgggatgtggttttgagtttcggggtagttcgcgaggttgggtttcgtgttgaggggcgtcgcgtttggtcgtgcgttgcgggagcgcgcgggtttggttcgttgttttggtcgttgcgaggcgtttagtttttttttgagtgtttcgtcgggttcgatagggtcgaggtcgtcggcgcgaggttttcggatagttgaggggcgcgagggcgtttttagttttttatttgttttttcgcgtcgt

SEQ ID NO: 40132 - DNA, 681 bp, Artificial Sequence
  chemically treated genomic DNA (Homo sapiens) CpG-island No: 40132
acgacgcgaaaaaacaaataaaaaactaaaaacgccctcgcgcccctcaactatccgaaaacctcgcgccgacgacctcgaccctatcgaacccgacgaaacactcaaaaaaaaactaaacgcctcgcaacgaccaaaacaacgaaccaaacccgcgcgctcccgcaacgcacgaccaaacgcgacgcccctcaacacgaaacccaacctcgcgaactaccccgaaactcaaaaccacatcccgcgcaaaaaaccgcgacgaccgaaaaaacaaaacaaaaacgaaaaaccaccgcgaaatcccgcctcccgctccgcgcctacgtctacgactacaccgaaattaaccgaaccgcgataaaacgaaaccgctcaaacgccttaaacgcgaaaccgtaaaacgaaaacgacgataaattcgaaataacaaaataactaaaacgaacgtactataacccttccctacgctacctcaaaatacctcccgctcgccgaaactaaattccgcgccgacgtaacctactaaattccaaacgccaaaaatcgacgcaaccgctctcaactttaaaaacgaaaccgaaaaacgaaatataaacctcacgaaactatcccccctaacctcgaacaacgctaaaacgaaaaaaaacaaacgaaaactcgcgaaaaccaccaacatccccg

SEQ ID NO: 40133 - DNA, 748 bp, Artificial Sequence
  chemically treated genomic DNA (Homo sapiens) CpG-island No: 40133
  misc_feature (730)..(732): n is either a, c, g or t
  misc_feature (743)..(743): n is either a, c, g or t
  misc_feature (745)..(745): n is either a, c, g or t
gtaggagttttacgaggtgtaggtttagcgttttagaaggatgagtagcggttcgttatagttcggaggcgggtgggtagcgttttaggtcgagggtttcgcgtcggtaaagatataggatttacgataaggcggttacggtttgagttaaaaggaaggtcgcgcgttttttttttagttcgtagtaagcgggtgttacgaggtatttagtcggttttcgaagttttttttacgcggttttaagattattatcgtagtttaggttaataagcgttgtcgggattttcgaggttacgaatgagtcgggagttattagtagtcggttaagtttcgcgagagcgcggtttcgtttttttagtatgtttcgcgtcgtcgtcgttgtcgtcgtcgtcgtcgtcgtcgcgtcgcggtttgagggcgggaggttgggggagggtagcggagtcggcgtcgtcgttatgttgggtttgaagcggttgttgtaggcgtcgacggagcgagcgggcgtgcggagcgggcgatagtggcgtgggatttgtttttttgcgagtagttgggagcggcggcggcggcgttatgagcgggggtattttttatatcggtagtaagattagttttatttttaaggcggagattcgttacgagggtattttttatattatcgatatcgaaaattttatcgtagtttttgttaaaggtacgcgggatcgggttttagggttgggggttnnnaaaaataaagntnaat

SEQ ID NO: 40134 - DNA, 748 bp, Artificial Sequence
  chemically treated genomic DNA (Homo sapiens) CpG-island No: 40134
  misc_feature (4)..(4): n is either a, c, g or t
  misc_feature (6)..(6): n is either a, c, g or t
  misc_feature (17)..(19): n is either a, c, g or t
attnanctttatttttnnnaacccccaaccctaaaacccgatcccgcgtacctttaacaaaaactacgataaaattttcgatatcgataatataaaaaataccctcgtaacgaatctccgccttaaaaataaaactaatcttactaccgatataaaaaatacccccgctcataacgccgccgccgccgctcccaactactcgcaaaaaaacaaatcccacgccactatcgcccgctccgcacgcccgctcgctccgtcgacgcctacaacaaccgcttcaaacccaacataacgacgacgccgactccgctaccctcccccaacctcccgccctcaaaccgcgacgcgacgacgacgacgacgacgacaacgacgacgacgcgaaacatactaaaaaaacgaaaccgcgctctcgcgaaacttaaccgactactaataactcccgactcattcgtaacctcgaaaatcccgacaacgcttattaacctaaactacgataataatcttaaaaccgcgtaaaaaaaacttcgaaaaccgactaaatacctcgtaacacccgcttactacgaactaaaaaaaaaacgcgcgaccttccttttaactcaaaccgtaaccgccttatcgtaaatcctatatctttaccgacgcgaaaccctcgacctaaaacgctacccacccgcctccgaactataacgaaccgctactcatccttctaaaacgctaaacctacacctcgtaaaactcctac

SEQ ID NO: 40135 - DNA, 748 bp, Artificial Sequence
  chemically treated genomic DNA (Homo sapiens) CpG-island No: 40135
  misc_feature (4)..(4): n is either a, c, g or t
  misc_feature (6)..(6): n is either a, c, g or t
  misc_feature (17)..(19): n is either a, c, g or t
attnanttttatttttnnnaatttttagttttgaggttcggtttcgcgtatttttggtaagggttacggtggagttttcggtgtcgatggtgtagaggatgttttcgtagcggattttcgttttggagatgaggttgattttgttgtcgatgtaaggggtgttttcgtttatggcgtcgtcgtcgtcgtttttagttgttcgtagagaggtagattttacgttattgtcgttcgtttcgtacgttcgttcgtttcgtcggcgtttatagtagtcgttttagatttaatatggcggcggcgtcggtttcgttatttttttttagtttttcgtttttaagtcgcggcgcggcggcggcggcggcggcggtagcggcggcggcgcggggtatgttgggagggcgaggtcgcgttttcgcgagatttggtcggttattggtggttttcggtttattcgtggtttcgggagtttcggtagcgtttgttggtttggattacggtggtggttttggggtcgcgtgagaggaatttcggggatcggttgagtgtttcgtggtattcgtttgttgcgggttggagaggaggcgcgcggttttttttttgatttaggtcgtggtcgttttgtcgtgggttttgtgtttttgtcgacgcggggttttcggtttggagcgttgtttattcgttttcgagttgtggcgagtcgttgtttatttttttaagacgttgaatttgtatttcgtggagtttttat

SEQ ID NO: 40136 - DNA, 748 bp, Artificial Sequence
  chemically treated genomic DNA (Homo sapiens) CpG-island No: 40136
  misc_feature (730)..(732): n is either a, c, g or t
  misc_feature (743)..(743): n is either a, c, g or t
  misc_feature (745)..(745): n is either a, c, g or t
ataaaaactccacgaaatacaaattcaacgtcttaaaaaaataaacaacgactcgccacaactcgaaaacgaataaacaacgctccaaaccgaaaaccccgcgtcgacaaaaacacaaaacccacgacaaaacgaccacgacctaaatcaaaaaaaaaaccgcgcgcctcctctccaacccgcaacaaacgaataccacgaaacactcaaccgatccccgaaattcctctcacgcgaccccaaaaccaccaccgtaatccaaaccaacaaacgctaccgaaactcccgaaaccacgaataaaccgaaaaccaccaataaccgaccaaatctcgcgaaaacgcgacctcgccctcccaacataccccgcgccgccgccgctaccgccgccgccgccgccgccgcgccgcgacttaaaaacgaaaaactaaaaaaaaataacgaaaccgacgccgccgccatattaaatctaaaacgactactataaacgccgacgaaacgaacgaacgtacgaaacgaacgacaataacgtaaaatctacctctctacgaacaactaaaaacgacgacgacgacgccataaacgaaaacaccccttacatcgacaacaaaatcaacctcatctccaaaacgaaaatccgctacgaaaacatcctctacaccatcgacaccgaaaactccaccgtaacccttaccaaaaatacgcgaaaccgaacctcaaaactaaaaattnnnaaaaataaaantnaat

SEQ ID NO: 40137 - DNA, 562 bp, Artificial Sequence
  chemically treated genomic DNA (Homo sapiens) CpG-island No: 40137
tcgcgggggggggcggggtcggtggattgggcgtgagttaattggttggggggcggggtattacgggttggtttcgtttaggcgttcgcgcggatttcgggtggaatgacgggagggagtttcggtagtttttattttttagcgatggcgtcgttgtgtcgcgtttagtttttagtttgtcggtcggtatttatcgttattcggagttcgtttagacggtgagatttggggcgggttcgaggtagcggcgggacgttatttgcgatcgggattatgaggagttgttagattcgtggggtcggtaacgagagtagtcgcggtatttgttgagaggaaagagggagcggttcggcgcggttggggcgcggtagaggtttgttcgattttcggttatgttattgttttgcgtgcgcggtgagtgcgcggattgaggcggggaggcggggtgtcggcgtagaggttttcgtatttttttagtggacgttcggtgatcgttttatttaaattttatatttcgttcgtgttttgggggtttattattttggtaattatttaataatta

SEQ ID NO: 40138 - DNA, 562 bp, Artificial Sequence
  chemically treated genomic DNA (Homo sapiens) CpG-island No: 40138
taattattaaataattaccaaaataataaacccccaaaacacgaacgaaatataaaatttaaataaaacgatcaccgaacgtccactaaaaaaatacgaaaacctctacgccgacaccccgcctccccgcctcaatccgcgcactcaccgcgcacgcaaaacaataacataaccgaaaatcgaacaaacctctaccgcgccccaaccgcgccgaaccgctccctctttcctctcaacaaataccgcgactactctcgttaccgaccccacgaatctaacaactcctcataatcccgatcgcaaataacgtcccgccgctacctcgaacccgccccaaatctcaccgtctaaacgaactccgaataacgataaataccgaccgacaaactaaaaactaaacgcgacacaacgacgccatcgctaaaaaataaaaactaccgaaactccctcccgtcattccacccgaaatccgcgcgaacgcctaaacgaaaccaacccgtaataccccgccccccaaccaattaactcacgcccaatccaccgaccccgcccccccccgcga

SEQ ID NO: 40139 - DNA, 562 bp, Artificial Sequence
  chemically treated genomic DNA (Homo sapiens) CpG-island No: 40139
tgattgttaagtgattgttaaaataatagatttttaaagtacggacgggatgtaaagtttgggtgagacggttatcggacgtttattggaagggtgcggggatttttacgtcgatatttcgttttttcgttttagttcgcgtatttatcgcgtacgtagagtagtgatatggtcgaggatcgggtaagtttttgtcgcgttttagtcgcgtcggatcgttttttttttttttttagtaggtgtcgcgattgttttcgttatcggttttacgggtttggtagttttttatggtttcggtcgtaggtagcgtttcgtcgttgtttcggattcgttttaaattttatcgtttgagcgaatttcgggtagcggtgagtatcggtcggtaggttggggattgggcgcggtatagcgacgttatcgttgggaggtaggagttgtcgggattttttttcgttattttattcgggattcgcgcgagcgtttgggcggagttaattcgtggtgtttcgttttttagttaattaatttacgtttagtttatcgatttcgttttttttcgcga

SEQ ID NO: 40140 - DNA, 562 bp, Artificial Sequence
  chemically treated genomic DNA (Homo sapiens) CpG-island No: 40140
tcgcgaaaaaaaacgaaatcgataaactaaacgtaaattaattaactaaaaaacgaaacaccacgaattaactccgcccaaacgctcgcgcgaatcccgaataaaataacgaaaaaaaatcccgacaactcctacctcccaacgataacgtcgctataccgcgcccaatccccaacctaccgaccgatactcaccgctacccgaaattcgctcaaacgataaaatttaaaacgaatccgaaacaacgacgaaacgctacctacgaccgaaaccataaaaaactaccaaacccgtaaaaccgataacgaaaacaatcgcgacacctactaaaaaaaaaaaaaaaacgatccgacgcgactaaaacgcgacaaaaacttacccgatcctcgaccatatcactactctacgtacgcgataaatacgcgaactaaaacgaaaaaacgaaatatcgacgtaaaaatccccgcacccttccaataaacgtccgataaccgtctcacccaaactttacatcccgtccgtactttaaaaatctattattttaacaatcacttaacaatca

SEQ ID NO: 40141 - DNA, 938 bp, Artificial Sequence
  chemically treated genomic DNA (Homo sapiens) CpG-island No: 40141
  misc_feature (306)..(306): n is either a, c, g or t
gttgtcgtttttcgtttttcggtattggtgatttattgttttaggttcgcggggttattttcgagatttcggtttcgaggatcgaggtgggatagggtttgcggatcgcgcgttgtcgttggatttagtttaatttaatttaggtttttttatttatcgggtgttcgtaggttacgtttttcgttcggagtttcgtttttagaacgcggtttcgttttcgatattgtagtttcgtttcgtttttcgggttaattttagtttaggcgttttttgtttcggtttttagcgcgcggtacgtcgggtttntcggggtcgcgtcgcgcgcgcgcgcgggttttgggcgggattttgtttaggcggcggggttgttgttgtcgtttttattaaggttgcgttatcggcgtttttacgttgattgtattttttgttgggtttgcgtttgttttaggcgtggtggtcggtttcgcgcggtgggcgcggtattttttattttttgtttattcgttttcgacgttttcgggttcgtcgcgtcgcggcggcgcgcgttgtagggttggtcgtagtttcgcgtgtcggtcgggtcggattgtgtgtaggtatgtcgtgtgttcgtcgcgggttcgttcgacgttcgtttttttggtggcgtttttcggcgttgttttattttcgcgttggatatcgcgtgtgtcgtttttcgcgatcggcgtggtcgtattttcgtataattcgcggtgcggcggtcgtttatattcggaagtacgttcgtggtttcggttggtatataatttcgcgtggtttttcgttcggagggttcggttttcgtttttttatttttttcgtatgcggatagtacgacgtacgtagtggggtggttaggtgtcgcgttattattattattcgcgttcgggttcgcgttcgtgcgacggtgggttttt

SEQ ID NO: 40142 - DNA, 938 bp, Artificial Sequence
  chemically treated genomic DNA (Homo sapiens) CpG-island No: 40142
  misc_feature (633)..(633): n is either a, c, g or t
aaaaacccaccgtcgcacgaacgcgaacccgaacgcgaataataataataacgcgacacctaaccaccccactacgtacgtcgtactatccgcatacgaaaaaaataaaaaaacgaaaaccgaaccctccgaacgaaaaaccacgcgaaattatataccaaccgaaaccacgaacgtacttccgaatataaacgaccgccgcaccgcgaattatacgaaaatacgaccacgccgatcgcgaaaaacgacacacgcgatatccaacgcgaaaataaaacaacgccgaaaaacgccaccaaaaaaacgaacgtcgaacgaacccgcgacgaacacacgacatacctacacacaatccgacccgaccgacacgcgaaactacgaccaaccctacaacgcgcgccgccgcgacgcgacgaacccgaaaacgtcgaaaacgaataaacaaaaaataaaaaataccgcgcccaccgcgcgaaaccgaccaccacgcctaaaacaaacgcaaacccaacaaaaaatacaatcaacgtaaaaacgccgataacgcaaccttaataaaaacgacaacaacaaccccgccgcctaaacaaaatcccgcccaaaacccgcgcgcgcgcgcgacgcgaccccganaaacccgacgtaccgcgcgctaaaaaccgaaacaaaaaacgcctaaactaaaattaacccgaaaaacgaaacgaaactacaatatcgaaaacgaaaccgcgttctaaaaacgaaactccgaacgaaaaacgtaacctacgaacacccgataaataaaaaaacctaaattaaattaaactaaatccaacgacaacgcgcgatccgcaaaccctatcccacctcgatcctcgaaaccgaaatctcgaaaataaccccgcgaacctaaaacaataaatcaccaataccgaaaaacgaaaaacgacaac

SEQ ID NO: 40143 - DNA, 938 bp, Artificial Sequence
  chemically treated genomic DNA (Homo sapiens) CpG-island No: 40143
  misc_feature (633)..(633): n is either a, c, g or t
ggggatttatcgtcgtacggacgcgaattcggacgcgggtggtggtgatggcgcggtatttggttattttattacgtgcgtcgtgttgttcgtatgcgggaggggtgggggggcgggaatcggatttttcggacggagaattacgcgaggttgtgtgttagtcggagttacgggcgtgttttcgggtgtgggcggtcgtcgtatcgcgggttgtgcgagggtgcgattacgtcggtcgcggggggcgatatacgcggtgtttagcgcgggggtggagtagcgtcggggggcgttattaggggggcgggcgtcgggcggattcgcggcgggtatacgatatgtttgtatataattcggttcggtcggtacgcgagattacgattagttttgtagcgcgcgtcgtcgcggcgcgacgaattcgggagcgtcgggggcgagtgaataggaggtggggggtgtcgcgtttatcgcgcggggtcggttattacgtttgggataggcgtaggtttagtagggagtatagttagcgtgagagcgtcggtagcgtagttttagtaggagcggtagtagtagtttcgtcgtttgggtagggtttcgtttaaagttcgcgcgcgcgcgcggcgcggtttcggnaagttcgacgtatcgcgcgttagaagtcggaatagagggcgtttgggttggggttagttcggggggcggggcgaggttgtagtatcgggggcggggtcgcgttttggaggcggggtttcgggcgaggggcgtggtttgcgggtattcggtgggtggggaggtttgggttgggttgggttgggtttagcggtagcgcgcggttcgtagattttgttttatttcggttttcgagatcgaagtttcggaggtggtttcgcggatttggagtagtgagttattagtgtcggggagcgggaggcggtagt

SEQ ID NO: 40144 - DNA, 938 bp, Artificial Sequence
  chemically treated genomic DNA (Homo sapiens) CpG-island No: 40144
  misc_feature (306)..(306): n is either a, c, g or t
actaccgcctcccgctccccgacactaataactcactactccaaatccgcgaaaccacctccgaaacttcgatctcgaaaaccgaaataaaacaaaatctacgaaccgcgcgctaccgctaaacccaacccaacccaacccaaacctccccacccaccgaatacccgcaaaccacgcccctcgcccgaaaccccgcctccaaaacgcgaccccgcccccgatactacaacctcgccccgccccccgaactaaccccaacccaaacgccctctattccgacttctaacgcgcgatacgtcgaacttnccgaaaccgcgccgcgcgcgcgcgcgaactttaaacgaaaccctacccaaacgacgaaactactactaccgctcctactaaaactacgctaccgacgctctcacgctaactatactccctactaaacctacgcctatcccaaacgtaataaccgaccccgcgcgataaacgcgacaccccccacctcctattcactcgcccccgacgctcccgaattcgtcgcgccgcgacgacgcgcgctacaaaactaatcgtaatctcgcgtaccgaccgaaccgaattatatacaaacatatcgtatacccgccgcgaatccgcccgacgcccgcccccctaataacgccccccgacgctactccacccccgcgctaaacaccgcgtatatcgccccccgcgaccgacgtaatcgcaccctcgcacaacccgcgatacgacgaccgcccacacccgaaaacacgcccgtaactccgactaacacacaacctcgcgtaattctccgtccgaaaaatccgattcccgcccccccacccctcccgcatacgaacaacacgacgcacgtaataaaataaccaaataccgcgccatcaccaccacccgcgtccgaattcgcgtccgtacgacgataaatcccc

SEQ ID NO: 40145 - DNA, 765 bp, Artificial Sequence
  chemically treated genomic DNA (Homo sapiens) CpG-island No: 40145
gcgtttgtcgtagtatttttcgttcgtataggttatattagtcggggtcgttcggtagtattaattcggcgaagtagtgtttttcgtttcgtttcgtcgggattttgggattttgcggttgttcgaagatgtttcgtacgtcgcggggtcggggcgttttaggtcgtcgtcgtagtttttgttgtagattaggtcggagcgggcgagcgggtcgggaggttcggggcgggggttttaggttttttcgggtagtttttcgggcgttgcgtttttcgcgcgtttcgggcgtagtggagaggggcgtcgggatatagaggcgcgaggatcggtcggggggcggcggcggtagttcggggtcgtttaggttttgtagatagcgcggcggttcggggtttaatagtagcgggtacgggcgttgttcgatggtcggggacgttatggttatgttcggttagtggcggtagttttggtagcggcggttttggcgattgcgttattttcgagttagtttcgagagaaggggtcgttttatattagcgcgtttttaaaggaatcgtagtttgttgggcggggcgggggcggggagagtcggagtggtaggaaggacgatttaagagaatcgtcgacggatcgaagggggtagggttcgtgttaggcgacgtttgcgcgagtgtggatttgggggcgtttttatttggagtagttgtaggatttcgtagaggagcgtttttgtatagtatagtttagagggcgtatttttgcggg

SEQ ID NO: 40146 - DNA, 765 bp, Artificial Sequence
  chemically treated genomic DNA (Homo sapiens) CpG-island No: 40146
cccgcaaaaatacgccctctaaactatactatacaaaaacgctcctctacgaaatcctacaactactccaaataaaaacgcccccaaatccacactcgcgcaaacgtcgcctaacacgaaccctacccccttcgatccgtcgacgattctcttaaatcgtccttcctaccactccgactctccccgcccccgccccgcccaacaaactacgattcctttaaaaacgcgctaatataaaacgaccccttctctcgaaactaactcgaaaataacgcaatcgccaaaaccgccgctaccaaaactaccgccactaaccgaacataaccataacgtccccgaccatcgaacaacgcccgtacccgctactattaaaccccgaaccgccgcgctatctacaaaacctaaacgaccccgaactaccgccgccgccccccgaccgatcctcgcgcctctatatcccgacgcccctctccactacgcccgaaacgcgcgaaaaacgcaacgcccgaaaaactacccgaaaaaacctaaaacccccgccccgaacctcccgacccgctcgcccgctccgacctaatctacaacaaaaactacgacgacgacctaaaacgccccgaccccgcgacgtacgaaacatcttcgaacaaccgcaaaatcccaaaatcccgacgaaacgaaacgaaaaacactacttcgccgaattaatactaccgaacgaccccgactaatataacctatacgaacgaaaaatactacgacaaacgc

SEQ ID NO: 40147 - DNA, 765 bp, Artificial Sequence
  chemically treated genomic DNA (Homo sapiens) CpG-island No: 40147
ttcgtagaaatgcgttttttgagttgtattgtatagaggcgtttttttgcggaattttgtagttgttttaggtgaagacgtttttaaatttatattcgcgtagacgtcgtttggtacggattttatttttttcggttcgtcggcggtttttttgggtcgttttttttgttatttcgatttttttcgttttcgtttcgtttagtaggttgcggtttttttaaaggcgcgttggtgtggggcggttttttttttcggggttggttcgggagtagcgtagtcgttaaagtcgtcgttgttaaagttgtcgttattagtcgggtatggttatggcgttttcggttatcgggtagcgttcgtattcgttattattggatttcgagtcgtcgcgttatttatagagtttgagcggtttcgagttatcgtcgtcgtttttcgatcggttttcgcgtttttgtgtttcggcgtttttttttattgcgttcggggcgcgcgaggggcgtagcgttcggagggttgttcgggggaatttggagttttcgtttcgggtttttcgattcgttcgttcgtttcggtttggtttgtagtagagattgcggcggcggtttggagcgtttcgatttcgcgacgtgcggagtattttcgagtagtcgtaggattttagagtttcggcggagcgaggcgaggggtattgtttcgtcgagttggtgttgtcgggcggtttcggttggtgtgatttgtgcggacgagaggtgttgcggtaggcgt

SEQ ID NO: 40148 - DNA, 765 bp, Artificial Sequence
  chemically treated genomic DNA (Homo sapiens) CpG-island No: 40148
acgcctaccgcaacacctctcgtccgcacaaatcacaccaaccgaaaccgcccgacaacaccaactcgacgaaacaatacccctcgcctcgctccgccgaaactctaaaatcctacgactactcgaaaatactccgcacgtcgcgaaatcgaaacgctccaaaccgccgccgcaatctctactacaaaccaaaccgaaacgaacgaacgaatcgaaaaacccgaaacgaaaactccaaattcccccgaacaaccctccgaacgctacgcccctcgcgcgccccgaacgcaataaaaaaaaacgccgaaacacaaaaacgcgaaaaccgatcgaaaaacgacgacgataactcgaaaccgctcaaactctataaataacgcgacgactcgaaatccaataataacgaatacgaacgctacccgataaccgaaaacgccataaccatacccgactaataacgacaactttaacaacgacgactttaacgactacgctactcccgaaccaaccccgaaaaaaaaaaccgccccacaccaacgcgcctttaaaaaaaccgcaacctactaaacgaaacgaaaacgaaaaaaatcgaaataacaaaaaaaacgacccaaaaaaaccgccgacgaaccgaaaaaaataaaatccgtaccaaacgacgtctacgcgaatataaatttaaaaacgtcttcacctaaaacaactacaaaattccgcaaaaaaacgcctctatacaatacaactcaaaaaacgcatttctacgaa

SEQ ID NO: 40149 - DNA, 519 bp, Artificial Sequence
  chemically treated genomic DNA (Homo sapiens) CpG-island No: 40149
gaggtcgttagcgtattaagggggtcgggtttgggatgcggcggagggaggtgggtattttttttcgggtttcgtttggcgtaagtttttagttttgagtttcgagtcgggagttggtcgggtagcggattaggtagagtcggcgggtcgtttgcgttttttttagcggggtgcgagcgttcgggcggttcggtaatttgtttttgttttcgcgtcgtttgcgtttgtagagtttcgggcgttcggttcgcgttttattttttgattcgttcgggttttgcggtttcgtgttttcggcgttagcgtttttttttcgtcgtcgtgtagagcgttattttcgtatttttttcgtttttcgcgttttttttgtttttcgcgtaaagtagttttgaagttattttttttgtaaggttttttaaagtcggttcggttgttattgcgtttttttttcgttttttcgtcgtttgggtgttattcgttttcggtggtaagtggatttagggaattgtaggttatata

SEQ ID NO: 40150 - DNA, 519 bp, Artificial Sequence
  chemically treated genomic DNA (Homo sapiens) CpG-island No: 40150
tatataacctacaattccctaaatccacttaccaccgaaaacgaataacacccaaacgacgaaaaaacgaaaaaaaaacgcaataacaaccgaaccgactttaaaaaaccttacaaaaaaaataacttcaaaactactttacgcgaaaaacaaaaaaaacgcgaaaaacgaaaaaaatacgaaaataacgctctacacgacgacgaaaaaaaaacgctaacgccgaaaacacgaaaccgcaaaacccgaacgaatcaaaaaataaaacgcgaaccgaacgcccgaaactctacaaacgcaaacgacgcgaaaacaaaaacaaattaccgaaccgcccgaacgctcgcaccccgctaaaaaaaacgcaaacgacccgccgactctacctaatccgctacccgaccaactcccgactcgaaactcaaaactaaaaacttacgccaaacgaaacccgaaaaaaaatacccacctccctccgccgcatcccaaacccgacccccttaatacgctaacgacctc

SEQ ID NO: 40151 - DNA, 519 bp, Artificial Sequence
  chemically treated genomic DNA (Homo sapiens) CpG-island No: 40151
tatatgatttgtagttttttgagtttatttgttatcgggggcgggtggtatttaggcggcggggaggcgggggaggggcgtagtgatagtcgagtcggttttgaggaattttgtagaggaagtggttttagaattgttttacgcgaggggtaggaaaggcgcgggaggcgggggaggtgcggagatggcgttttgtacggcggcggagggagggcgttggcgtcggggatacgaaatcgtagagttcggacgagttagggagtgaggcgcgagtcgggcgttcggggttttgtaggcgtaggcggcgcggggataggagtaggttatcgggtcgttcgagcgttcgtatttcgttgaaagaaacgtaggcggttcgtcggttttgtttggttcgttattcgattagttttcggttcggggtttagagttaggggtttacgttaagcggagttcggggaggggtgtttattttttttcgtcgtattttaagttcggtttttttgatgcgttggcggtttt

SEQ ID NO: 40152 - DNA, 519 bp, Artificial Sequence
  chemically treated genomic DNA (Homo sapiens) CpG-island No: 40152
aaaaccgccaacgcatcaaaaaaaccgaacttaaaatacgacgaaaaaaaataaacacccctccccgaactccgcttaacgtaaacccctaactctaaaccccgaaccgaaaactaatcgaataacgaaccaaacaaaaccgacgaaccgcctacgtttctttcaacgaaatacgaacgctcgaacgacccgataacctactcctatccccgcgccgcctacgcctacaaaaccccgaacgcccgactcgcgcctcactccctaactcgtccgaactctacgatttcgtatccccgacgccaacgccctccctccgccgccgtacaaaacgccatctccgcacctcccccgcctcccgcgcctttcctacccctcgcgtaaaacaattctaaaaccacttcctctacaaaattcctcaaaaccgactcgactatcactacgcccctcccccgcctccccgccgcctaaataccacccgcccccgataacaaataaactcaaaaaactacaaatcatata

SEQ ID NO: 40153 - DNA, 576 bp, Artificial Sequence
  chemically treated genomic DNA (Homo sapiens) CpG-island No: 40153
ttgcgggggggagatcgattaatacgcggggagaggcggtttgcgtattgagcgtttttgcgtttttttattgattgatttattgagttcggttcgtttatattattaagcggtatgagtttgttgacgcgtcggcgttcggcgagcgttttcgtttggcgtttgtcgtttcggtgtttatttttttttttttttcgtttattttttcgattattttttttttattatttttttcgcgatttttttatttatttttcgtgtattttttttttttttaattttttttcgttcgttttttttttttttgttattttcgatttttcgtttgtatcgcgtttttttttttttttttttttttttttttcgttttttttttttttttttttattttttatttttttttttttttttttacgtttttatttttttttacggtcgatttatcgtttgtttttttcgttttttttgtttcgttttcgttttttttttttttttttttttttattcgtttttttttttttttttttttgttttattttttttttttttttttttttttttttatttttttttttt

SEQ ID NO: 40154 - DNA, 576 bp, Artificial Sequence
  chemically treated genomic DNA (Homo sapiens) CpG-island No: 40154
aaaaaaaaaaaataaaaaaaaaaaaaaaaaaaaaaaaaaaataaaacaaaaaaaaaaaaaaaaaaaaacgaataaaaaaaaaaaaaaaaaaaaaaaacgaaaacgaaacaaaaaaaacgaaaaaaacaaacgataaatcgaccgtaaaaaaaaataaaaacgtaaaaaaaaaaaaaaaaaaataaaaaataaaaaaaaaaaaaaaaaaaacgaaaaaaaaaaaaaaaaaaaaaaaaaaaaacgcgatacaaacgaaaaatcgaaaataacaaaaaaaaaaaaaacgaacgaaaaaaaattaaaaaaaaaaaaaatacacgaaaaataaataaaaaaatcgcgaaaaaaataataaaaaaaaaataatcgaaaaaataaacgaaaaaaaaaaaaaaataaacaccgaaacgacaaacgccaaacgaaaacgctcgccgaacgccgacgcgtcaacaaactcataccgcttaataatataaacgaaccgaactcaataaatcaatcaataaaaaaacgcaaaaacgctcaatacgcaaaccgcctctccccgcgtattaatcgatctcccccccgcaa

SEQ ID NO: 40155 - DNA, 576 bp, Artificial Sequence
  chemically treated genomic DNA (Homo sapiens) CpG-island No: 40155
ggagagagaggatggaaaaagagggagaggggaaagaagaataaaataaaggaggggagggggaaaaacgagtggggagaaaaaaaaggggggggagcgggggcgggataggaagggcgggagaggtagacggtaaatcgatcgtggaagaaggtgaggacgtgaaaaaaggggggaaagaataggagatgagaaagggaggaaaaaaggcgggaggggggaaaaggagagggagaaaaaacgcggtataagcgaagggtcgagggtgataaggaaagagagggcgggcggaggggaattggaaagaagggggatgtacgaggggtaagtgaaaagatcgcgaaagaaataatgggagggagatgatcggagggatgagcgggggaaagggaaaaataggtatcgggacggtaaacgttaggcggaagcgttcgtcggacgtcggcgcgttagtaaatttatatcgtttgataatatggacgggtcgagtttagtgagttagttagtgagaaagcgtaagagcgtttaatacgtaagtcgttttttttcgcgtgttgatcgatttttttttcgtag

SEQ ID NO: 40156 - DNA, 576 bp, Artificial Sequence
  chemically treated genomic DNA (Homo sapiens) CpG-island No: 40156
ctacgaaaaaaaaatcgatcaacacgcgaaaaaaaacgacttacgtattaaacgctcttacgctttctcactaactaactcactaaactcgacccgtccatattatcaaacgatataaatttactaacgcgccgacgtccgacgaacgcttccgcctaacgtttaccgtcccgatacctatttttccctttcccccgctcatccctccgatcatctccctcccattatttctttcgcgatcttttcacttacccctcgtacatcccccttctttccaattcccctccgcccgccctctctttccttatcaccctcgacccttcgcttataccgcgttttttctccctctccttttcccccctcccgccttttttcctccctttctcatctcctattctttccccccttttttcacgtcctcaccttcttccacgatcgatttaccgtctacctctcccgcccttcctatcccgcccccgctccccccccttttttttctccccactcgtttttccccctcccctcctttattttattcttctttcccctctccctctttttccatcctctctctcc

SEQ ID NO: 40157 - DNA, 509 bp, Artificial Sequence
  chemically treated genomic DNA (Homo sapiens) CpG-island No: 40157
gaaagaaaacgagggaaggggtagaacgcgtcgggtggaggagaagggggaacgagtattaggaaaaagggcgacgggatagcgaatagaagaaaaggcgtcggcgagatagcgataagttagggagaaggaggagggggaaaggagggggagcgatagacgcggcgacgtacgttcgtagggtgggacgaacggataaagcgggaaaaaaataagcgatcgcggcggaggtagaaagaacggatcggcgcgttatcggtcgtttggaattttttattagatttttttgttggacgggtatttttagatgattgtagtttcgagaagtcgaaatttattttagaaaatcgaaatttattaagttttttttcgcgtgttttataaaaattttttattgttttagtcgggcgcgattttttttggttttttttgttaggattagtgaatttcgttcgagagttttattaataaagtaggtcgtttttgattattagttatttaaattttgt

SEQ ID NO: 40158 - DNA, 509 bp, Artificial Sequence
  chemically treated genomic DNA (Homo sapiens) CpG-island No: 40158
acaaaatttaaataactaataatcaaaaacgacctactttattaataaaactctcgaacgaaattcactaatcctaacaaaaaaaaccaaaaaaaatcgcgcccgactaaaacaataaaaaatttttataaaacacgcgaaaaaaaacttaataaatttcgattttctaaaataaatttcgacttctcgaaactacaatcatctaaaaatacccgtccaacaaaaaaatctaataaaaaattccaaacgaccgataacgcgccgatccgttctttctacctccgccgcgatcgcttatttttttcccgctttatccgttcgtcccaccctacgaacgtacgtcgccgcgtctatcgctccccctcctttccccctcctccttctccctaacttatcgctatctcgccgacgccttttcttctattcgctatcccgtcgccctttttcctaatactcgttcccccttctcctccacccgacgcgttctaccccttccctcgttttctttc

SEQ ID NO: 40159 - DNA, 509 bp, Artificial Sequence
  chemically treated genomic DNA (Homo sapiens) CpG-island No: 40159
atagaatttaggtgattaatggttagaggcgatttgttttattaatggagttttcgggcgaggtttattggttttaataaggagggttaggggaagtcgcgttcgattggggtagtagagggtttttatagagtacgcggggaggggtttagtaagtttcggttttttgggataggtttcgatttttcggggttgtagttatttgaaagtgttcgtttagtaggaaaatttggtgggagattttaagcggtcggtggcgcgtcggttcgttttttttgttttcgtcgcggtcgtttgtttttttttcgttttgttcgttcgttttattttgcgggcgtacgtcgtcgcgtttgtcgttttttttttttttttttttttttttttttttggtttgtcgttgtttcgtcggcgtttttttttttgttcgttatttcgtcgtttttttttttggtgttcgttttttttttttttttattcgacgcgttttattttttttttcgttttttttt

SEQ ID NO: 40160 - DNA, 509 bp, Artificial Sequence
  chemically treated genomic DNA (Homo sapiens) CpG-island No: 40160
aaaaaaaaacgaaaaaaaaaataaaacgcgtcgaataaaaaaaaaaaaaaaacgaacaccaaaaaaaaaaacgacgaaataacgaacaaaaaaaaaaacgccgacgaaacaacgacaaaccaaaaaaaaaaaaaaaaaaaaaaaaaaaaaaaacgacaaacgcgacgacgtacgcccgcaaaataaaacgaacgaacaaaacgaaaaaaaaacaaacgaccgcgacgaaaacaaaaaaaacgaaccgacgcgccaccgaccgcttaaaatctcccaccaaattttcctactaaacgaacactttcaaataactacaaccccgaaaaatcgaaacctatcccaaaaaaccgaaacttactaaacccctccccgcgtactctataaaaaccctctactaccccaatcgaacgcgacttcccctaaccctccttattaaaaccaataaacctcgcccgaaaactccattaataaaacaaatcgcctctaaccattaatcacctaaattctat

SEQ ID NO: 40161 - DNA, 508 bp, Artificial Sequence
  chemically treated genomic DNA (Homo sapiens) CpG-island No: 40161
ggtcgttcgagagttttagtaggtttcggggcgcgaaaggtaatttgggagtagtagttttttcgggcgtttagcgggatcgttagcgcggtagtgggggttttcgcggttgtaagttagcgggttttgtgagggcgagcggaggcggagaaagggcgcgggagtgagagagggtgagttagttattgtttatgtaataaagggaggttttatcgcgggatagggttgaatttagaagtgcggttcgtgtcgtagtttgttttaggacgcggtttgttttagcgttagcgagggaaggttgaggaggagttagagtttggttttgtagtttttttcgtcgttagcgttcgtcgttatttttattatgtagtttcgggaagacgtttcgcgttttcgtcgtttcgttagttttcgtggtgggaggcggtttaagaggatttttaagttttcggtttcggttttttttacgggtttagaggagttaaaggatacggtttattttgtagtt

SEQ ID NO: 40162 - DNA, 508 bp, Artificial Sequence
  chemically treated genomic DNA (Homo sapiens) CpG-island No: 40162
aactacaaaataaaccgtatcctttaactcctctaaacccgtaaaaaaaaccgaaaccgaaaacttaaaaatcctcttaaaccgcctcccaccacgaaaactaacgaaacgacgaaaacgcgaaacgtcttcccgaaactacataataaaaataacgacgaacgctaacgacgaaaaaaactacaaaaccaaactctaactcctcctcaaccttccctcgctaacgctaaaacaaaccgcgtcctaaaacaaactacgacacgaaccgcacttctaaattcaaccctatcccgcgataaaacctccctttattacataaacaataactaactcaccctctctcactcccgcgccctttctccgcctccgctcgccctcacaaaacccgctaacttacaaccgcgaaaacccccactaccgcgctaacgatcccgctaaacgcccgaaaaaactactactcccaaattacctttcgcgccccgaaacctactaaaactctcgaacgacc

SEQ ID NO: 40163 - DNA, 508 bp, Artificial Sequence
  chemically treated genomic DNA (Homo sapiens) CpG-island No: 40163
ggttgtagaatgggtcgtgttttttaatttttttggattcgtgaaaaaggtcgaaatcgagggtttggaaatttttttgggtcgttttttattacggggattggcgaggcggcgagagcgcgggacgttttttcgggattgtatggtggagatggcgacgggcgttgacggcgagaaaggttgtaggattaggttttggtttttttttaattttttttcgttgacgttaagataagtcgcgttttggaatagattgcggtacgggtcgtatttttgaatttagttttatttcgcggtgaggtttttttttattgtatagatagtggttgatttatttttttttattttcgcgtttttttttcgttttcgttcgtttttataggattcgttggtttgtagtcgcggaagtttttattgtcgcgttggcgatttcgttaggcgttcgggagaattattgtttttaggttgtttttcgcgtttcgaggtttgttggggttttcggacggtt

SEQ ID NO: 40164 - DNA, 508 bp, Artificial Sequence
  chemically treated genomic DNA (Homo sapiens) CpG-island No: 40164
aaccgtccgaaaaccccaacaaacctcgaaacgcgaaaaacaacctaaaaacaataattctcccgaacgcctaacgaaatcgccaacgcgacaataaaaacttccgcgactacaaaccaacgaatcctataaaaacgaacgaaaacgaaaaaaaaacgcgaaaataaaaaaaaataaatcaaccactatctatacaataaaaaaaaacctcaccgcgaaataaaactaaattcaaaaatacgacccgtaccgcaatctattccaaaacgcgacttatcttaacgtcaacgaaaaaaaattaaaaaaaaaccaaaacctaatcctacaacctttctcgccgtcaacgcccgtcgccatctccaccatacaatcccgaaaaaacgtcccgcgctctcgccgcctcgccaatccccgtaataaaaaacgacccaaaaaaatttccaaaccctcgatttcgacctttttcacgaatccaaaaaaattaaaaaacacgacccattctacaacc

SEQ ID NO: 40165 - DNA, 510 bp, Artificial Sequence
  chemically treated genomic DNA (Homo sapiens) CpG-island No: 40165
gttcgggagttcgagagttttagtagttttcggggcgcgaaaggtaatttgggagcggtagtttttttgggcgtttagtattgtcgtttacgttgtagtagcggtttttgcggttttaagttagcgggttttgtgaaggcgagtagacgcggagaaaggacgcgggagtgagagagggtgagttagttattgtttaaacgataacgggaggcggttttgcggggtagggttgaatttagtaaatgggttcgtgttgttgttttttcggagacgttgttattttagcgttagcgagggaaggttgaggaggagttagagtcgggttttgtagcgtttttcgttattagcgttcgtcgttatttttattatgtagtttcgggaagacgtttcgcgttttcgtcgtttagttagttttcgtggtgggaagcggtttaagaagatttataaatttatagtttcggttttttttacgggtttagaggaattaaaggatacggtttattttgtagt

SEQ ID NO: 40166 - DNA, 510 bp, Artificial Sequence
  chemically treated genomic DNA (Homo sapiens) CpG-island No: 40166
actacaaaataaaccgtatcctttaattcctctaaacccgtaaaaaaaaccgaaactataaatttataaatcttcttaaaccgcttcccaccacgaaaactaactaaacgacgaaaacgcgaaacgtcttcccgaaactacataataaaaataacgacgaacgctaataacgaaaaacgctacaaaacccgactctaactcctcctcaaccttccctcgctaacgctaaaataacaacgtctccgaaaaaacaacaacacgaacccatttactaaattcaaccctaccccgcaaaaccgcctcccgttatcgtttaaacaataactaactcaccctctctcactcccgcgtcctttctccgcgtctactcgccttcacaaaacccgctaacttaaaaccgcaaaaaccgctactacaacgtaaacgacaatactaaacgcccaaaaaaactaccgctcccaaattacctttcgcgccccgaaaactactaaaactctcgaactcccgaac

SEQ ID NO: 40167 - DNA, 510 bp, Artificial Sequence
  chemically treated genomic DNA (Homo sapiens) CpG-island No: 40167
gttgtagaatgggtcgtgttttttaatttttttggattcgtgaaaaaggtcgaaattgtgggtttgtgaatttttttgggtcgttttttattacggggattggttaggcggcgagagcgcggggcgttttttcgggattgtatggtggagatggcgacgggcgttgatggcgagaaacgttgtaggattcggttttggtttttttttaattttttttcgttgacgttaagatagtagcgttttcgaagagatagtagtacgagtttatttattgaatttaattttatttcgtagaatcgtttttcgttatcgtttagatagtggttgatttatttttttttattttcgcgtttttttttcgcgtttgttcgtttttataggattcgttggtttggagtcgtagaagtcgttattgtagcgtgggcgataatgttaggcgtttaggagaattatcgtttttaggttgtttttcgcgtttcgagggttgttgggattttcggattttcgggt

SEQ ID NO: 40168 - DNA, 510 bp, Artificial Sequence
  chemically treated genomic DNA (Homo sapiens) CpG-island No: 40168
acccgaaaatccgaaaatcccaacaaccctcgaaacgcgaaaaacaacctaaaaacgataattctcctaaacgcctaacattatcgcccacgctacaataacgacttctacgactccaaaccaacgaatcctataaaaacgaacaaacgcgaaaaaaaaacgcgaaaataaaaaaaaataaatcaaccactatctaaacgataacgaaaaacgattctacgaaataaaattaaattcaataaataaactcgtactactatctcttcgaaaacgctactatcttaacgtcaacgaaaaaaaattaaaaaaaaaccaaaaccgaatcctacaacgtttctcgccatcaacgcccgtcgccatctccaccatacaatcccgaaaaaacgccccgcgctctcgccgcctaaccaatccccgtaataaaaaacgacccaaaaaaattcacaaacccacaatttcgacctttttcacgaatccaaaaaaattaaaaaacacgacccattctacaac

SEQ ID NO: 40169 - DNA, 621 bp, Artificial Sequence
  chemically treated genomic DNA (Homo sapiens) CpG-island No: 40169
gggggaggatttttgaggggttgttgcgagttcggcgcggtagagagtacggtagttattatcggtcgaggcggttgtgttcgggtattgcggagagcggcgtgaagtttttggaaagagcgcggcgggggtgaggcgagtcgtagaagatcgcggaaaggaagcgtacggaggagcggttcggtagttttcgtgggtcggtcggagcgggaaagtggggtttcgcgattttcgaggtaaataaagagcggtgggtagcggaggttaagtttggttcgcgtcggtcgtcgttagatcgtttgtttttaaggttcgaggattcggggatcggggggcggtagcgcggtttacggttatttattaagatgcgtttgaagaggttgttttttttgggcggtagtagtacgttcggtatcgtggtcggtagggaggttaggtggtcggtagggaggttaggtgttcgggcgtttcgtttcgcgggggtgggtatcgggacgaatcgttgttgagagtcgggttgcgggcgatggattagtttattggtttatagttgtaattgggtagtttggttgttcggtacgggtggtaatggagaaggaaggcggtttgagtaggatacgt

SEQ ID NO: 40170 - DNA, 621 bp, Artificial Sequence
  chemically treated genomic DNA (Homo sapiens) CpG-island No: 40170
acgtatcctactcaaaccgccttccttctccattaccacccgtaccgaacaaccaaactacccaattacaactataaaccaataaactaatccatcgcccgcaacccgactctcaacaacgattcgtcccgatacccacccccgcgaaacgaaacgcccgaacacctaacctccctaccgaccacctaacctccctaccgaccacgataccgaacgtactactaccgcccaaaaaaaacaacctcttcaaacgcatcttaataaataaccgtaaaccgcgctaccgccccccgatccccgaatcctcgaaccttaaaaacaaacgatctaacgacgaccgacgcgaaccaaacttaacctccgctacccaccgctctttatttacctcgaaaatcgcgaaaccccactttcccgctccgaccgacccacgaaaactaccgaaccgctcctccgtacgcttcctttccgcgatcttctacgactcgcctcacccccgccgcgctctttccaaaaacttcacgccgctctccgcaatacccgaacacaaccgcctcgaccgataataactaccgtactctctaccgcgccgaactcgcaacaacccctcaaaaatcctccccc

SEQ ID NO: 40171 - DNA, 621 bp, Artificial Sequence
  chemically treated genomic DNA (Homo sapiens) CpG-island No: 40171
gcgtgttttgtttagatcgttttttttttttattgttattcgtgtcgaatagttaggttgtttaattgtaattgtagattaatgaattaatttatcgttcgtagttcgatttttagtagcggttcgtttcggtgtttattttcgcgaagcggagcgttcgggtatttagtttttttgtcggttatttagtttttttgtcggttacgatgtcgaacgtgttgttgtcgtttaaggagagtaatttttttaaacgtattttggtgagtggtcgtaggtcgcgttgtcgtttttcggttttcgggttttcgggttttaagggtaagcggtttggcggcggtcggcgcgggttaggtttggttttcgttgtttatcgttttttgtttatttcggaggtcgcgggattttattttttcgtttcggtcggtttacgggggttgtcgagtcgttttttcgtgcgtttttttttcgcggttttttgcggttcgttttattttcgtcgcgttttttttagaaattttacgtcgtttttcgtagtgttcgggtatagtcgtttcggtcggtagtggttgtcgtgttttttgtcgcgtcgggttcgtagtagttttttagggattttttttt

SEQ ID NO: 40172 - DNA, 621 bp, Artificial Sequence
  chemically treated genomic DNA (Homo sapiens) CpG-island No: 40172
aaaaaaaaatccctaaaaaactactacgaacccgacgcgacaaaaaacacgacaaccactaccgaccgaaacgactatacccgaacactacgaaaaacgacgtaaaatttctaaaaaaaacgcgacgaaaataaaacgaaccgcaaaaaaccgcgaaaaaaaaacgcacgaaaaaacgactcgacaacccccgtaaaccgaccgaaacgaaaaaataaaatcccgcgacctccgaaataaacaaaaaacgataaacaacgaaaaccaaacctaacccgcgccgaccgccgccaaaccgcttacccttaaaacccgaaaacccgaaaaccgaaaaacgacaacgcgacctacgaccactcaccaaaatacgtttaaaaaaattactctccttaaacgacaacaacacgttcgacatcgtaaccgacaaaaaaactaaataaccgacaaaaaaactaaatacccgaacgctccgcttcgcgaaaataaacaccgaaacgaaccgctactaaaaatcgaactacgaacgataaattaattcattaatctacaattacaattaaacaacctaactattcgacacgaataacaataaaaaaaaaaaacgatctaaacaaaacacgc

SEQ ID NO: 40173 - DNA, 783 bp, Artificial Sequence
  chemically treated genomic DNA (Homo sapiens) CpG-island No: 40173
ttttcggatttgtgttttagtttagagaaagaagaaaatgtgtgtgtgtggcgagggggagggttcgtattgagtagtcgtttcgcgtttggtaatcggggtagggggtgggcgtttggcgggggcgggggcggaggcggaggcggaggagcgcgcggttgtcgggcgggacgggaatcgggtttgcgcgcgagtcgggcggtgggcgcggatagggtcgagggcgttcgggagtcgtgttaggcggcggcgaggagcgggcgcgtcgggcgcggggagtcgtcggcggtcgttcgttgcggggatatttcggtgaatgagttttcgtcgttaggcgtacggcgtaggggagtttcgtaggcggcggcggcggcggcggttcggggggcgaggcgggtcgtttgttttcggggaaggaggcgcgggcgtttgagcgaggtcgggcgcggcggtttttttttacgcgtttttcgagttagcgttcgtttttcgcgttcgttttttttttttcgtcggtttagattattcgtttttatcgcgttttcggtttatttggtggtttcggttttggtcgtcgttttcgcgggcggttttcggagttcgtttcggacgcgcgttcgggcggcgggggtttcggcggttatcgttgtttcgggggagtaagggcgggagggtgtgtgtgcgcgttgtgagtagggggtgtcggcggggttgtagcggaggtatttttgaagaatgattttggagtttattatggcgtgttgtttgagcgaggaggttaag

SEQ ID NO: 40174 - DNA, 783 bp, Artificial Sequence
  chemically treated genomic DNA (Homo sapiens) CpG-island No: 40174
cttaacctcctcgctcaaacaacacgccataataaactccaaaatcattcttcaaaaatacctccgctacaaccccgccgacaccccctactcacaacgcgcacacacaccctcccgcccttactcccccgaaacaacgataaccgccgaaacccccgccgcccgaacgcgcgtccgaaacgaactccgaaaaccgcccgcgaaaacgacgaccaaaaccgaaaccaccaaataaaccgaaaacgcgataaaaacgaataatctaaaccgacgaaaaaaaaaaaacgaacgcgaaaaacgaacgctaactcgaaaaacgcgtaaaaaaaaaccgccgcgcccgacctcgctcaaacgcccgcgcctccttccccgaaaacaaacgacccgcctcgccccccgaaccgccgccgccgccgccgcctacgaaactcccctacgccgtacgcctaacgacgaaaactcattcaccgaaatatccccgcaacgaacgaccgccgacgactccccgcgcccgacgcgcccgctcctcgccgccgcctaacacgactcccgaacgccctcgaccctatccgcgcccaccgcccgactcgcgcgcaaacccgattcccgtcccgcccgacaaccgcgcgctcctccgcctccgcctccgcccccgcccccgccaaacgcccaccccctaccccgattaccaaacgcgaaacgactactcaatacgaaccctccccctcgccacacacacacattttcttctttctctaaactaaaacacaaatccgaaaa

SEQ ID NO: 40175 - DNA, 783 bp, Artificial Sequence
  chemically treated genomic DNA (Homo sapiens) CpG-island No: 40175
tttggttttttcgtttaggtagtacgttatgatggattttagagttattttttaaaagtgttttcgttgtagtttcgtcggtattttttgtttatagcgcgtatatatattttttcgtttttgttttttcgaggtagcggtggtcgtcgaagttttcgtcgttcgggcgcgcgttcgggacgagtttcgggaatcgttcgcgggggcggcggttagggtcggggttattaggtgggtcgggggcgcggtgggagcggatagtttgggtcgacgggagaagagaggcgggcgcgggaggcgggcgttggttcggggggcgcgtgagagaaggtcgtcgcgttcggtttcgtttagacgttcgcgttttttttttcgggaataggcggttcgtttcgtttttcgagtcgtcgtcgtcgtcgtcgtttgcgaggtttttttacgtcgtgcgtttggcggcgagagtttatttatcggggtgttttcgtagcgagcggtcgtcgacggtttttcgcgttcggcgcgttcgtttttcgtcgtcgtttgatacggttttcgggcgttttcggttttgttcgcgtttatcgttcggttcgcgcgtagattcggttttcgtttcgttcggtaatcgcgcgttttttcgttttcgttttcgttttcgttttcgttagacgtttattttttgtttcgattgttaggcgcggagcggttgtttagtgcgagttttttttttcgttatatatatatatttttttttttttttgaattggagtatagattcgggag

SEQ ID NO: 40176 - DNA, 783 bp, Artificial Sequence
  chemically treated genomic DNA (Homo sapiens) CpG-island No: 40176
ctcccgaatctatactccaattcaaaaaaaaaaaaaaatatatatatataacgaaaaaaaaaactcgcactaaacaaccgctccgcgcctaacaatcgaaacaaaaaataaacgtctaacgaaaacgaaaacgaaaacgaaaacgaaaaaacgcgcgattaccgaacgaaacgaaaaccgaatctacgcgcgaaccgaacgataaacgcgaacaaaaccgaaaacgcccgaaaaccgtatcaaacgacgacgaaaaacgaacgcgccgaacgcgaaaaaccgtcgacgaccgctcgctacgaaaacaccccgataaataaactctcgccgccaaacgcacgacgtaaaaaaacctcgcaaacgacgacgacgacgacgactcgaaaaacgaaacgaaccgcctattcccgaaaaaaaaaacgcgaacgtctaaacgaaaccgaacgcgacgaccttctctcacgcgccccccgaaccaacgcccgcctcccgcgcccgcctctcttctcccgtcgacccaaactatccgctcccaccgcgcccccgacccacctaataaccccgaccctaaccgccgcccccgcgaacgattcccgaaactcgtcccgaacgcgcgcccgaacgacgaaaacttcgacgaccaccgctacctcgaaaaaacaaaaacgaaaaaatatatatacgcgctataaacaaaaaataccgacgaaactacaacgaaaacacttttaaaaaataactctaaaatccatcataacgtactacctaaacgaaaaaaccaaa

SEQ ID NO: 40177 - DNA, 1109 bp, Artificial Sequence
  chemically treated genomic DNA (Homo sapiens) CpG-island No: 40177
taattttttttttttttagattttattcgtttcgttattttttttcgttttcggtttcgttagtttaatttgttagagaagttgtgtataaattgcgcggtcgttttgcgcgcgaagttcgtggttcgagaggggtgcggtcgggtcgacggaggcggggttttggttgtttttttttttgtttataggttggtcgtttaggtttggtcggtttcggggtttcgggattcgcggcggcgttgttaattaggcgatcgggtttcgttttttcggagttgggtgaaatagaggcgggcgttaagtgttagtagtcgcggggtaggtacgtgcgttcgcggttttttcgcggaggtcggcggtggcgggagcgggtttcggagagtttgagagtacggtggggcggggcgggagaaagtggtcgttcggaggacgttggcgtttacgtgtggaagagcggaagagttttgtttttcgtgcgcgttttcgaaaattgtttgtcgttgtttgaggagtttattcgaaattttttttttttcgtcggtagtttcgcgttgagttcgtcgatttaagttagcgtgggcgaggtgggaagtgcgttcgattcgcgtttggagttgcgttttcgagtgtttatggttataagggtgttgagtatgagcgttcgtttgggattcgtgttttagtcgtcggcgtcgtaggacgagtcggtgttcgcgtagtttaagtcggtgttgggcgtcgcgaattcggttcgcgacgcggcgttttttttcggcgaggagttgaagtacgcgtattatcgttcgtaggcgtagttcgcgttcgcgtaggtttcgtagtcggtttagtcgttcgttatcggttcgcggttgtttttagaggatttggtttaggtaggaagagtcgttttttttttatcgtagtattttcgggttcgggcgtgtttcgttgttgcgattcgcgggcgataggggtcgttttaggttggggcgtgcgtcggggcgtatcggagtcggtgttgggtgggtagtttcgttttgtacgtttggtcggggtttcgcgtttcgttgagagtaaatgggggggggggtcgggggtgggaaggatgg

SEQ ID NO: 40178 - DNA, 1109 bp, Artificial Sequence
  chemically treated genomic DNA (Homo sapiens) CpG-island No: 40178
ccatccttcccacccccgacccccccccccatttactctcaacgaaacgcgaaaccccgaccaaacgtacaaaacgaaactacccacccaacaccgactccgatacgccccgacgcacgccccaacctaaaacgacccctatcgcccgcgaatcgcaacaacgaaacacgcccgaacccgaaaatactacgataaaaaaaaaacgactcttcctacctaaaccaaatcctctaaaaacaaccgcgaaccgataacgaacgactaaaccgactacgaaacctacgcgaacgcgaactacgcctacgaacgataatacgcgtacttcaactcctcgccgaaaaaaaacgccgcgtcgcgaaccgaattcgcgacgcccaacaccgacttaaactacgcgaacaccgactcgtcctacgacgccgacgactaaaacacgaatcccaaacgaacgctcatactcaacacccttataaccataaacactcgaaaacgcaactccaaacgcgaatcgaacgcacttcccacctcgcccacgctaacttaaatcgacgaactcaacgcgaaactaccgacgaaaaaaaaaaaatttcgaataaactcctcaaacaacgacaaacaattttcgaaaacgcgcacgaaaaacaaaactcttccgctcttccacacgtaaacgccaacgtcctccgaacgaccactttctcccgccccgccccaccgtactctcaaactctccgaaacccgctcccgccaccgccgacctccgcgaaaaaaccgcgaacgcacgtacctaccccgcgactactaacacttaacgcccgcctctatttcacccaactccgaaaaaacgaaacccgatcgcctaattaacaacgccgccgcgaatcccgaaaccccgaaaccgaccaaacctaaacgaccaacctataaacaaaaaaaaaaacaaccaaaaccccgcctccgtcgacccgaccgcacccctctcgaaccacgaacttcgcgcgcaaaacgaccgcgcaatttatacacaacttctctaacaaattaaactaacgaaaccgaaaacgaaaaaaaataacgaaacgaataaaatctaaaaaaaaaaaaaatta

SEQ ID NO: 40179 - DNA, 1109 bp, Artificial Sequence
  chemically treated genomic DNA (Homo sapiens) CpG-island No: 40179
ttattttttttattttcggtttttttttttatttatttttagcgaaacgcggggtttcggttaggcgtgtagggcggggttgtttatttagtatcggtttcggtgcgtttcgacgtacgttttagtttggagcggtttttgtcgttcgcgagtcgtagtaacgggatacgttcgagttcgggagtgttgcggtgggaggggagcggttttttttatttggattaggttttttggaggtagtcgcgggtcggtggcgggcggttgggtcggttgcggggtttgcgcgggcgcgggttgcgtttgcgggcggtggtgcgcgtgttttagtttttcgtcggggaagagcgtcgcgtcgcgggtcggattcgcggcgtttagtatcggtttgagttgcgcgaatatcggttcgttttgcggcgtcggcggttggggtacgggttttaggcgggcgtttatgtttagtatttttgtagttatgggtattcgggggcgtagttttaggcgcgggtcgggcgtattttttatttcgtttacgttggtttgggtcggcgagtttagcgcggggttgtcggcggaggaggggaggtttcgggtggattttttagatagcggtaggtagttttcgaaggcgcgtacgaaaagtaaaattttttcgtttttttatacgtaaacgttaacgtttttcgggcggttattttttttcgtttcgttttatcgtgtttttaggtttttcggagttcgttttcgttatcgtcgattttcgcgagagaatcgcgagcgtacgtatttgtttcgcgattattgatatttgacgttcgtttttattttatttaatttcgggggggcggggttcgatcgtttgattggtagcgtcgtcgcgaatttcgaggtttcgaggtcggttaggtttgagcggttagtttatgagtagggagagaggtagttagggtttcgttttcgtcggttcgatcgtatttttttcgggttacgagtttcgcgcgtagggcggtcgcgtagtttgtatataatttttttgatagattgggttggcggagtcgggggcggagggaagtagcggagcgggtggaatttgggaagagggggaatta

SEQ ID NO: 40180 - DNA, 1109 bp, Artificial Sequence
  chemically treated genomic DNA (Homo sapiens) CpG-island No: 40180
taattccccctcttcccaaattccacccgctccgctacttccctccgcccccgactccgccaacccaatctatcaaaaaaattatatacaaactacgcgaccgccctacgcgcgaaactcgtaacccgaaaaaaatacgatcgaaccgacgaaaacgaaaccctaactacctctctccctactcataaactaaccgctcaaacctaaccgacctcgaaacctcgaaattcgcgacgacgctaccaatcaaacgatcgaaccccgcccccccgaaattaaataaaataaaaacgaacgtcaaatatcaataatcgcgaaacaaatacgtacgctcgcgattctctcgcgaaaatcgacgataacgaaaacgaactccgaaaaacctaaaaacacgataaaacgaaacgaaaaaaaataaccgcccgaaaaacgttaacgtttacgtataaaaaaacgaaaaaattttacttttcgtacgcgccttcgaaaactacctaccgctatctaaaaaatccacccgaaacctcccctcctccgccgacaaccccgcgctaaactcgccgacccaaaccaacgtaaacgaaataaaaaatacgcccgacccgcgcctaaaactacgcccccgaatacccataactacaaaaatactaaacataaacgcccgcctaaaacccgtaccccaaccgccgacgccgcaaaacgaaccgatattcgcgcaactcaaaccgatactaaacgccgcgaatccgacccgcgacgcgacgctcttccccgacgaaaaactaaaacacgcgcaccaccgcccgcaaacgcaacccgcgcccgcgcaaaccccgcaaccgacccaaccgcccgccaccgacccgcgactacctccaaaaaacctaatccaaataaaaaaaaccgctcccctcccaccgcaacactcccgaactcgaacgtatcccgttactacgactcgcgaacgacaaaaaccgctccaaactaaaacgtacgtcgaaacgcaccgaaaccgatactaaataaacaaccccgccctacacgcctaaccgaaaccccgcgtttcgctaaaaataaataaaaaaaaaaaccgaaaataaaaaaaataa

SEQ ID NO: 40181 - DNA, 569 bp, Artificial Sequence
  chemically treated genomic DNA (Homo sapiens) CpG-island No: 40181
taagacgcgtttaggtcgtttggttatttttattagtcgtagtcgttagttaagtttgtgcgacgattacgaggagtagatagacgaatattttttcgatcgcgattcggtcgttttttagttggtttataatttttatttgttcggggtgttgttggtgttcgacgggttgtgttcgcgtcgttttttggaggagttgggttattggggcgtgcggtttaagtatacgttacgttgttgtcgtatttgtttcgaggagcggcgcgacgagttgagcgaacggtttaagatttagtacgagttgcgcgcgtaggcgtaggtcgaggaggcggaggaattttttcgcgatatgcgtttttacggttcgtagcggcgtcgtttttggaattttatggagaagttatttttttcggtggtcgttaaggttatcggggtggtttttagtattttcgtgttcgttttcgtggtggcgttggcgtttaatatcgtggaggagatgtagtagtattcggggtagggcgagggcggtttagatttgcggtttattttggagtacgtggagatgttgt

SEQ ID NO: 40182 - DNA, 569 bp, Artificial Sequence
  chemically treated genomic DNA (Homo sapiens) CpG-island No: 40182
acaacatctccacgtactccaaaataaaccgcaaatctaaaccgccctcgccctaccccgaatactactacatctcctccacgatattaaacgccaacgccaccacgaaaacgaacacgaaaatactaaaaaccaccccgataaccttaacgaccaccgaaaaaaataacttctccataaaattccaaaaacgacgccgctacgaaccgtaaaaacgcatatcgcgaaaaaattcctccgcctcctcgacctacgcctacgcgcgcaactcgtactaaatcttaaaccgttcgctcaactcgtcgcgccgctcctcgaaacaaatacgacaacaacgtaacgtatacttaaaccgcacgccccaataacccaactcctccaaaaaacgacgcgaacacaacccgtcgaacaccaacaacaccccgaacaaataaaaattataaaccaactaaaaaacgaccgaatcgcgatcgaaaaaatattcgtctatctactcctcgtaatcgtcgcacaaacttaactaacgactacgactaataaaaataaccaaacgacctaaacgcgtctta

SEQ ID NO: 40183 - DNA, 569 bp, Artificial Sequence
  chemically treated genomic DNA (Homo sapiens) CpG-island No: 40183
atagtatttttacgtgttttaggatgggtcgtaggtttgggtcgttttcgttttgtttcgagtgttgttgtattttttttacggtgttgagcgttagcgttattacggagacgagtacgaaggtgttggaggttatttcgatggttttggcggttatcgaggagaatggtttttttatgaggttttagaggcggcgtcgttgcgggtcgtagaagcgtatgtcgcggaagagttttttcgttttttcgatttgcgtttgcgcgcgtagttcgtgttggattttgagtcgttcgtttagttcgtcgcgtcgtttttcgaagtagatgcggtagtagcgtggcgtgtatttgagtcgtacgttttagtagtttagtttttttaggaagcggcgcggatatagttcgtcgagtattagtagtatttcggataggtagaaattgtagattagttggaagacggtcgggtcgcggtcgaagaagtattcgtttgtttgtttttcgtagtcgtcgtataggtttagttggcggttgcggttggtggaggtggttaggcgatttaggcgcgttttg

SEQ ID NO: 40184 - DNA, 569 bp, Artificial Sequence
  chemically treated genomic DNA (Homo sapiens) CpG-island No: 40184
caaaacgcgcctaaatcgcctaaccacctccaccaaccgcaaccgccaactaaacctatacgacgactacgaaaaacaaacaaacgaatacttcttcgaccgcgacccgaccgtcttccaactaatctacaatttctacctatccgaaatactactaatactcgacgaactatatccgcgccgcttcctaaaaaaactaaactactaaaacgtacgactcaaatacacgccacgctactaccgcatctacttcgaaaaacgacgcgacgaactaaacgaacgactcaaaatccaacacgaactacgcgcgcaaacgcaaatcgaaaaaacgaaaaaactcttccgcgacatacgcttctacgacccgcaacgacgccgcctctaaaacctcataaaaaaaccattctcctcgataaccgccaaaaccatcgaaataacctccaacaccttcgtactcgtctccgtaataacgctaacgctcaacaccgtaaaaaaaatacaacaacactcgaaacaaaacgaaaacgacccaaacctacgacccatcctaaaacacgtaaaaatactat

SEQ ID NO: 40185 - DNA, 626 bp, Artificial Sequence
  chemically treated genomic DNA (Homo sapiens) CpG-island No: 40185
tcgcgtggagttttgttgttttttttgcgttttttcgttggttaggatcgtttttaggtttttgttacgtttcgggagcgttacgaatttaatagtcgtttaagtcgtttttcggttcgcggtttgcggacgcgttcggagttgggggttttcgttaatagttgtcgtatcgtgtcgcgtcgtagtcgtacgttagcggggttaacggcgcggtaggcgtaggggttttcgttaaggttcggaagaggattttgaaaatggtttttgggtatgcgttatagcggtcgttacgagacgtaaaatcgacgttttggaattgagagtttagagggacggagttcggcgtattatgaggttttcggggtttaaggtcgatcgtgagagcgtacgaggttggcgagtttcgcggggaggtcgaggcgcgggtgcgggcgtcggcgtagtcgcggcggtagcgttacgtagcgaggtcgtgcgtgcgcgggcgttagggcggcgttgagttgaggacgttggcggtttcgcgacgagttttgttttttcggttgggtatgttgtttatcgtaggatgatggaagcgacggttcgtataaagatagaagcgttggttttagtgagtagggttt

SEQ ID NO: 40186 - DNA, 626 bp, Artificial Sequence
  chemically treated genomic DNA (Homo sapiens) CpG-island No: 40186
aaaccctactcactaaaaccaacgcttctatctttatacgaaccgtcgcttccatcatcctacgataaacaacatacccaaccgaaaaaacaaaactcgtcgcgaaaccgccaacgtcctcaactcaacgccgccctaacgcccgcgcacgcacgacctcgctacgtaacgctaccgccgcgactacgccgacgcccgcacccgcgcctcgacctccccgcgaaactcgccaacctcgtacgctctcacgatcgaccttaaaccccgaaaacctcataatacgccgaactccgtccctctaaactctcaattccaaaacgtcgattttacgtctcgtaacgaccgctataacgcatacccaaaaaccattttcaaaatcctcttccgaaccttaacgaaaacccctacgcctaccgcgccgttaaccccgctaacgtacgactacgacgcgacacgatacgacaactattaacgaaaacccccaactccgaacgcgtccgcaaaccgcgaaccgaaaaacgacttaaacgactattaaattcgtaacgctcccgaaacgtaacaaaaacctaaaaacgatcctaaccaacgaaaaaacgcaaaaaaaacaacaaaactccacgcga

SEQ ID NO: 40187 - DNA, 626 bp, Artificial Sequence
  chemically treated genomic DNA (Homo sapiens) CpG-island No: 40187
aaattttgtttattgaaattaacgtttttgtttttgtacgggtcgtcgtttttattattttgcggtaagtagtatgtttaatcgaaaaaataaagttcgtcgcggagtcgttagcgtttttaatttagcgtcgttttgacgttcgcgtacgtacggtttcgttgcgtgacgttatcgtcgcggttacgtcggcgttcgtattcgcgtttcggttttttcgcggggttcgttaatttcgtgcgtttttacggtcggttttgggtttcgggagttttatggtgcgtcgagtttcgtttttttaggtttttagttttaaggcgtcggttttgcgtttcgtaacggtcgttgtggcgtatgtttagaagttatttttaaggttttttttcgaattttggcgaggatttttgcgtttgtcgcgtcgttgatttcgttagcgtgcggttgcgacgcggtacggtacggtagttgttggcgaaggtttttaatttcgagcgcgttcgtagatcgcgagtcggaaggcggtttgggcggttgttgagttcgtggcgttttcgaggcgtggtaaaggtttaaaaacggttttggttagcggaaaggcgtaagaggagtagtaaggttttacgcga

SEQ ID NO: 40188 - DNA, 626 bp, Artificial Sequence
  chemically treated genomic DNA (Homo sapiens) CpG-island No: 40188
tcgcgtaaaaccttactactcctcttacgcctttccgctaaccaaaaccgtttttaaacctttaccacgcctcgaaaacgccacgaactcaacaaccgcccaaaccgccttccgactcgcgatctacgaacgcgctcgaaattaaaaaccttcgccaacaactaccgtaccgtaccgcgtcgcaaccgcacgctaacgaaatcaacgacgcgacaaacgcaaaaatcctcgccaaaattcgaaaaaaaaccttaaaaataacttctaaacatacgccacaacgaccgttacgaaacgcaaaaccgacgccttaaaactaaaaacctaaaaaaacgaaactcgacgcaccataaaactcccgaaacccaaaaccgaccgtaaaaacgcacgaaattaacgaaccccgcgaaaaaaccgaaacgcgaatacgaacgccgacgtaaccgcgacgataacgtcacgcaacgaaaccgtacgtacgcgaacgtcaaaacgacgctaaattaaaaacgctaacgactccgcgacgaactttattttttcgattaaacatactacttaccgcaaaataataaaaacgacgacccgtacaaaaacaaaaacgttaatttcaataaacaaaattt

SEQ ID NO: 40189 - DNA, 616 bp, Artificial Sequence
  chemically treated genomic DNA (Homo sapiens) CpG-island No: 40189
agcggaataagttagatgacgttatttcgttcgttaaagtatattacgtggttttcgtagtacgtgattcgtgttttcgtcgtaggtaaaagaatgacgtacgttagttttagatcgtgcgttttatatttttttcggtaacgaagttcgttgtttgggtttaaatttttttagagtgtggtatcgtcggtgttggaagttatttgtttttagagtcggtttaacgtagtcgtacggggtcgttgtaggtcgaggtttcgatttttttaagtcgcgtatggttattggttgttgaggtgtttattcgacgtatttaatttttcgttttcgttttttatgtttgacgtatgcgtagtggtttcgtcggcgaggtttcgcgaatttaggagaatgtgcgcgcgtagggtggcgttgagggaagttttgagttttttatggggtttcgaattttatttcgggcgtgtgttttttcgggattttaatttcgtttattttatatatagttgttatagttgttcgtttttttagggtagaatgcgatttcggtttttcgcgttttttgagagggaatatatttttatgaagaattcgtaattatgtttttttcgaaatatta

SEQ ID NO: 40190 - DNA, 616 bp, Artificial Sequence
  chemically treated genomic DNA (Homo sapiens) CpG-island No: 40190
taatatttcgaaaaaaacataattacgaattcttcataaaaatatattccctctcaaaaaacgcgaaaaaccgaaatcgcattctaccctaaaaaaacgaacaactataacaactatatataaaataaacgaaattaaaatcccgaaaaaacacacgcccgaaataaaattcgaaaccccataaaaaactcaaaacttccctcaacgccaccctacgcgcgcacattctcctaaattcgcgaaacctcgccgacgaaaccactacgcatacgtcaaacataaaaaacgaaaacgaaaaattaaatacgtcgaataaacacctcaacaaccaataaccatacgcgacttaaaaaaatcgaaacctcgacctacaacgaccccgtacgactacgttaaaccgactctaaaaacaaataacttccaacaccgacgataccacactctaaaaaaatttaaacccaaacaacgaacttcgttaccgaaaaaaatataaaacgcacgatctaaaactaacgtacgtcattcttttacctacgacgaaaacacgaatcacgtactacgaaaaccacgtaatatactttaacgaacgaaataacgtcatctaacttattccgct

SEQ ID NO: 40191 - DNA, 616 bp, Artificial Sequence
  chemically treated genomic DNA (Homo sapiens) CpG-island No: 40191
taatgtttcgagagagatatagttgcgagttttttatggaggtgtgtttttttttaaaaagcgcgggaagtcggagtcgtattttattttaggagggcgggtaattgtagtagttgtgtgtaagataaacgagattggggtttcggaggggtatacgttcgggatagggttcgaagttttatggagaatttaaagttttttttaacgttattttgcgcgcgtatatttttttgggttcgcgggatttcgtcggcgaggttattgcgtatgcgttaggtatggagagcggaagcggaaggttgaatgcgtcgggtgggtattttagtaattagtagttatgcgcggtttggaggagtcggggtttcggtttatagcgatttcgtgcggttgcgttaagtcggttttggagataggtaatttttaatatcggcggtgttatattttggagaggtttaggtttaggtagcggatttcgttgtcgagaggggtgtaaaacgtacgatttggaattgacgtgcgttatttttttatttacggcgaaggtacgggttacgtgttgcggagattacgtgatgtgttttggcgagcgggatgacgttatttggtttgtttcgtt

SEQ ID NO: 40192 - DNA, 616 bp, Artificial Sequence
  chemically treated genomic DNA (Homo sapiens) CpG-island No: 40192
aacgaaacaaaccaaataacgtcatcccgctcgccaaaacacatcacgtaatctccgcaacacgtaacccgtaccttcgccgtaaataaaaaaataacgcacgtcaattccaaatcgtacgttttacacccctctcgacaacgaaatccgctacctaaacctaaacctctccaaaatataacaccgccgatattaaaaattacctatctccaaaaccgacttaacgcaaccgcacgaaatcgctataaaccgaaaccccgactcctccaaaccgcgcataactactaattactaaaatacccacccgacgcattcaaccttccgcttccgctctccatacctaacgcatacgcaataacctcgccgacgaaatcccgcgaacccaaaaaaatatacgcgcgcaaaataacgttaaaaaaaactttaaattctccataaaacttcgaaccctatcccgaacgtatacccctccgaaaccccaatctcgtttatcttacacacaactactacaattacccgccctcctaaaataaaatacgactccgacttcccgcgctttttaaaaaaaaacacacctccataaaaaactcgcaactatatctctctcgaaacatta

SEQ ID NO: 40193 - DNA, 1605 bp, Artificial Sequence
  chemically treated genomic DNA (Homo sapiens) CpG-island No: 40193
ggtacgaaatttggtcgttcgtttagtttagagcgggtcgggaggtttcgcggggtcgtttttcgcgggaaagttattggttcgttggggtattcggtcgcggcgttaattggttcgcgtcggttcgcggcggggggggggttcgcgacggcgggtagtcgcgttaaattcgggagacgaatggggtaatttttataggtcggatttacgtttacgtagtcgcgtcgtaagagggtcgtttttaggtttttatagttcgtaaggcgcgcggtcgatcgtattaggtcgtttttaagtacgtgggaggttagaggtcgttcggtttacgagtcgagtcgaagttcgtttaaaatttcgcgcgttcggcgcggggcgggggcggtcgtttgtcgttgtttttttaagaagggggagggggtcggtagcgcgttcgcgacgggatgagtcggcggcggtcgcggcgcgcggttttcgttagtgggagttaagtttcggcggggcggggggaaatagatcgagggttcggcgcgggaagaggcggtcgttagttagcgtcgagggcgggcgggtaaggttaagttcgtgggtcggtttattaggcgtagggagacgggtattcgttaatatggcgttgcggcggtttgtggcgcgtttcggttggcgtgaagagtcgtcgttcgtttatacggaggggttagtttttcggggtaagggtaggggtttcgggcgtcgtcgtcgcggtatagggggaagggcgaggtcgtcgttataacggttggttttggtcgattcgggttgtttttgggaggtaggagtgggtaaggtcgagggcgaagagggagcgagagaacgggggagaaagttttatttttgggtttgaaaaatggcgggaattacgttttttttttaaatttggtttcgggaggggcggcggttgcgttattttcgtcgttttggttcgtttttttttcgtttcgcgcgtcgggtcgcgttcgtttaggtttttaggcgttcgagggggtttttcgttttttttaaaagaaaaaagtttttttttcgttttacgattgttgatttcggtcgggtcggcgtttacggcgagtttcggttataagagttttcgtttcgttttattcgcgtttttttttcggtcggttcggggcgcgcggagttcggtttggtttaggcggggatggtcgcgtagtttttcggtaggtcgggttttcgttcggtcgcgtatttcgggaggttgtaaatatggtttttagcgttatataattttcgtttttttttttcgtcgtcggttatttgtatacgcgtttttttaggggaaagatttcggcgggcgaagcgtttaaagtttgtttttttttatatcgttgttttttttcggtcgttttaggggttcgcgggcggtaaagagttaattttcgcgcgttcgttttttttttcgcgttcgttcgtttttttcgttcgagtttacgagttgcgttttttttcgcgtcggggtcggcgaatttttagttcgggtttcgtaggtggttattattatatgtaagttatcgggggagagggtatttatagaatgcggaataaaagaggttt

SEQ ID NO: 40194 - DNA, 1605 bp, Artificial Sequence
  chemically treated genomic DNA (Homo sapiens) CpG-island No: 40194
aaacctcttttattccgcattctataaataccctctcccccgataacttacatataataataaccacctacgaaacccgaactaaaaattcgccgaccccgacgcgaaaaaaaacgcaactcgtaaactcgaacgaaaaaaacgaacgaacgcgaaaaaaaaaacgaacgcgcgaaaattaactctttaccgcccgcgaacccctaaaacgaccgaaaaaaaacaacgatataaaaaaaaacaaactttaaacgcttcgcccgccgaaatctttcccctaaaaaaacgcgtatacaaataaccgacgacgaaaaaaaaaaacgaaaattatataacgctaaaaaccatatttacaacctcccgaaatacgcgaccgaacgaaaacccgacctaccgaaaaactacgcgaccatccccgcctaaaccaaaccgaactccgcgcgccccgaaccgaccgaaaaaaaaacgcgaataaaacgaaacgaaaactcttataaccgaaactcgccgtaaacgccgacccgaccgaaatcaacaatcgtaaaacgaaaaaaaaacttttttcttttaaaaaaaacgaaaaaccccctcgaacgcctaaaaacctaaacgaacgcgacccgacgcgcgaaacgaaaaaaaaacgaaccaaaacgacgaaaataacgcaaccgccgcccctcccgaaaccaaatttaaaaaaaaaacgtaattcccgccatttttcaaacccaaaaataaaactttctcccccgttctctcgctccctcttcgccctcgaccttacccactcctacctcccaaaaacaacccgaatcgaccaaaaccaaccgttataacgacgacctcgcccttccccctataccgcgacgacgacgcccgaaacccctacccttaccccgaaaaactaacccctccgtataaacgaacgacgactcttcacgccaaccgaaacgcgccacaaaccgccgcaacgccatattaacgaatacccgtctccctacgcctaataaaccgacccacgaacttaaccttacccgcccgccctcgacgctaactaacgaccgcctcttcccgcgccgaaccctcgatctatttccccccgccccgccgaaacttaactcccactaacgaaaaccgcgcgccgcgaccgccgccgactcatcccgtcgcgaacgcgctaccgaccccctcccccttcttaaaaaaacaacgacaaacgaccgcccccgccccgcgccgaacgcgcgaaattttaaacgaacttcgactcgactcgtaaaccgaacgacctctaacctcccacgtacttaaaaacgacctaatacgatcgaccgcgcgccttacgaactataaaaacctaaaaacgaccctcttacgacgcgactacgtaaacgtaaatccgacctataaaaattaccccattcgtctcccgaatttaacgcgactacccgccgtcgcgaaccccccccccgccgcgaaccgacgcgaaccaattaacgccgcgaccgaataccccaacgaaccaataactttcccgcgaaaaacgaccccgcgaaacctcccgacccgctctaaactaaacgaacgaccaaatttcgtacc

SEQ ID NO: 40195 - DNA, 1605 bp, Artificial Sequence
  chemically treated genomic DNA (Homo sapiens) CpG-island No: 40195
aggttttttttgtttcgtattttatgggtgttttttttttcgatgatttgtatgtaatggtggttatttgcggggttcgggttgagggttcgtcggtttcggcgcggggaagagcgtagttcgtgggttcggacggggaaggcgggcgggcgcggaggggggagcgagcgcgcgaggattaattttttgtcgttcgcgggtttttggggcggtcggggggaggtagcggtgtgggggaaagtaaattttgagcgtttcgttcgtcggggttttttttttgagggagcgcgtgtgtaagtggtcggcggcgagagagggaggcgggggttgtgtaacgttgggagttatgtttgtagtttttcgggatgcgcggtcgggcggaggttcggtttgtcgaggagttgcgcggttattttcgtttgggttaggtcgggtttcgcgcgtttcgggtcggtcggggaaggggcgcgggtggggcgggacgggggtttttgtggtcggagttcgtcgtgggcgtcggttcggtcgaggttagtagtcgtggggcgaggagggggttttttttttttgaagggagcgagaagttttttcgggcgtttggaggtttgggcgggcgcggttcggcgcgcggagcgggggaggggcgggttagggcggcggaggtggcgtaatcgtcgtttttttcgaggttaagtttgaaaaaaggacgtggttttcgttattttttaagtttaaaaataaaattttttttttcgttttttcgtttttttttcgttttcggttttgtttatttttgttttttaggggtagttcgggtcgattaaggttaatcgttgtggcgacggtttcgtttttttttttgtgtcgcggcggcggcgttcggggtttttgtttttgtttcgggaggttggttttttcgtgtgggcgggcggcggttttttacgttagtcggggcgcgttataggtcgtcgtagcgttatgttggcgggtgttcgtttttttgcgtttggtgagtcggtttacgagtttggttttgttcgttcgttttcggcgttggttggcggtcgttttttttcgcgtcgagttttcggtttgttttttttcgtttcgtcggggtttggtttttattggcgggagtcgcgcgtcgcggtcgtcgtcgatttatttcgtcgcgggcgcgttgtcgattttttttttttttttaaaagggtaacggtaggcggtcgttttcgtttcgcgtcgggcgcgcgggattttgggcgggtttcggttcggttcgtgggtcgggcggtttttggttttttacgtgtttgagagcggtttggtgcggtcggtcgcgcgttttgcgggttgtaggggtttgagggcggtttttttgcggcgcggttgcgtgggcgtgggttcgatttgtgggaattgttttattcgtttttcgggtttagcgcggttgttcgtcgtcgcgagtttttttttcgtcgcggatcggcgcgggttagttagcgtcgcggtcgggtgttttagcgggttagtggttttttcgcggagggcggtttcgcggggtttttcgattcgttttgggttaagcgagcggttaggtttcgtgtt

SEQ ID NO: 40196 - DNA, 1605 bp, Artificial Sequence
  chemically treated genomic DNA (Homo sapiens) CpG-island No: 40196
aacacgaaacctaaccgctcgcttaacccaaaacgaatcgaaaaaccccgcgaaaccgccctccgcgaaaaaaccactaacccgctaaaacacccgaccgcgacgctaactaacccgcgccgatccgcgacgaaaaaaaaactcgcgacgacgaacaaccgcgctaaacccgaaaaacgaataaaacaattcccacaaatcgaacccacgcccacgcaaccgcgccgcaaaaaaaccgccctcaaacccctacaacccgcaaaacgcgcgaccgaccgcaccaaaccgctctcaaacacgtaaaaaaccaaaaaccgcccgacccacgaaccgaaccgaaacccgcccaaaatcccgcgcgcccgacgcgaaacgaaaacgaccgcctaccgttacccttttaaaaaaaaaaaaaaaatcgacaacgcgcccgcgacgaaataaatcgacgacgaccgcgacgcgcgactcccgccaataaaaaccaaaccccgacgaaacgaaaaaaaacaaaccgaaaactcgacgcgaaaaaaaacgaccgccaaccaacgccgaaaacgaacgaacaaaaccaaactcgtaaaccgactcaccaaacgcaaaaaaacgaacacccgccaacataacgctacgacgacctataacgcgccccgactaacgtaaaaaaccgccgcccgcccacacgaaaaaaccaacctcccgaaacaaaaacaaaaaccccgaacgccgccgccgcgacacaaaaaaaaaaacgaaaccgtcgccacaacgattaaccttaatcgacccgaactacccctaaaaaacaaaaataaacaaaaccgaaaacgaaaaaaaaacgaaaaaacgaaaaaaaaaattttatttttaaacttaaaaaataacgaaaaccacgtccttttttcaaacttaacctcgaaaaaaacgacgattacgccacctccgccgccctaacccgcccctcccccgctccgcgcgccgaaccgcgcccgcccaaacctccaaacgcccgaaaaaacttctcgctcccttcaaaaaaaaaaaaccccctcctcgccccacgactactaacctcgaccgaaccgacgcccacgacgaactccgaccacaaaaacccccgtcccgccccacccgcgccccttccccgaccgacccgaaacgcgcgaaacccgacctaacccaaacgaaaataaccgcgcaactcctcgacaaaccgaacctccgcccgaccgcgcatcccgaaaaactacaaacataactcccaacgttacacaacccccgcctccctctctcgccgccgaccacttacacacgcgctccctcaaaaaaaaaaccccgacgaacgaaacgctcaaaatttactttcccccacaccgctacctccccccgaccgccccaaaaacccgcgaacgacaaaaaattaatcctcgcgcgctcgctcccccctccgcgcccgcccgccttccccgtccgaacccacgaactacgctcttccccgcgccgaaaccgacgaaccctcaacccgaaccccgcaaataaccaccattacatacaaatcatcgaaaaaaaaaacacccataaaatacgaaacaaaaaaaacct

SEQ ID NO: 40197 - DNA, 968 bp, Artificial Sequence
  chemically treated genomic DNA (Homo sapiens) CpG-island No: 40197
cgtcgtttacgtgaggcgtttggattttgttcggttttcgtagttttttttttttagtaggtggttttggtttttttttttaattcgggcgtttacgttatcggcgaatttttaattagcgttagcgtcgttattaatcgcgaaaataaataaattttcgcgttcggcggacgcgttaggtttcgtcgggggtttcgttttcgtttcgaggtttttacgtcgtttttttcggtcgggtttttttttatttttcgttcgttcgtttgtttttagtcgcgtttttttcgttttttatcgtagtttgtagtcgcgtttattttcgcggttcgtttcggcgtttcgggattcgttagtgtttagtttgtgggtcgatcgtgattttcgttcggcgcgagtttgtttttagttttgtcgatatttgatttagattagttttaacgtttagtgcggtcgttcggggagtcgcgggagaggcggcggcggggggaggagggagaggagggtcgagtcggcggtacgggaggttcggtgagtacgcggaggcgggttcgtttcgcgggtgttcgtttcggtatttcggaggcgtaggtagcggttcgatagcgtttttttcggcgtttcggtttcgggtggcggggattcggtttgaggcgacgggttttattgatcggagtcgttgggtagagggtacgggagggtcgcggttcgacgttcggcgtaaggttcggggcggcggggagggattcgtattcgatttttaggtcggcgatcgttgagtttttcgagatttcgtgggggtcgttcgagtgataggtgttatagtttttttttcgtcgttggcgttcgcgttttttttcgggtattcgggcgttcggaaatttttggagtaacgatttgattcgtttttttttttttaggttttgaagtcgtttttttgttcgagttaggtttcgtttagcgtaattttt

SEQ ID NO: 40198 - DNA, 968 bp, Artificial Sequence
  chemically treated genomic DNA (Homo sapiens) CpG-island No: 40198
aaaaattacgctaaacgaaacctaactcgaacaaaaaaacgacttcaaaacctaaaaaaaaaaaaacgaatcaaatcgttactccaaaaatttccgaacgcccgaatacccgaaaaaaaacgcgaacgccaacgacgaaaaaaaaactataacacctatcactcgaacgacccccacgaaatctcgaaaaactcaacgatcgccgacctaaaaatcgaatacgaatccctccccgccgccccgaaccttacgccgaacgtcgaaccgcgaccctcccgtaccctctacccaacgactccgatcaataaaacccgtcgcctcaaaccgaatccccgccacccgaaaccgaaacgccgaaaaaaacgctatcgaaccgctacctacgcctccgaaataccgaaacgaacacccgcgaaacgaacccgcctccgcgtactcaccgaacctcccgtaccgccgactcgaccctcctctccctcctccccccgccgccgcctctcccgcgactccccgaacgaccgcactaaacgttaaaactaatctaaatcaaatatcgacaaaactaaaaacaaactcgcgccgaacgaaaatcacgatcgacccacaaactaaacactaacgaatcccgaaacgccgaaacgaaccgcgaaaataaacgcgactacaaactacgataaaaaacgaaaaaaacgcgactaaaaacaaacgaacgaacgaaaaataaaaaaaaacccgaccgaaaaaaacgacgtaaaaacctcgaaacgaaaacgaaacccccgacgaaacctaacgcgtccgccgaacgcgaaaatttatttattttcgcgattaataacgacgctaacgctaattaaaaattcgccgataacgtaaacgcccgaattaaaaaaaaaaaccaaaaccacctactaaaaaaaaaaaactacgaaaaccgaacaaaatccaaacgcctcacgtaaacgacg

SEQ ID NO: 40199 - DNA, 968 bp, Artificial Sequence
  chemically treated genomic DNA (Homo sapiens) CpG-island No: 40199
agaaattgcgttgggcgaaatttaattcgggtagagaagcggttttaaaatttgaaagggagaaaacgagttaggtcgttgttttagaaattttcgagcgttcgggtgttcgggagggagcgcgggcgttagcggcggggaggggattgtggtatttgttattcgagcggtttttacggggtttcgggaggtttagcggtcgtcggtttgggagtcgggtgcgagttttttttcgtcgtttcgagttttgcgtcgagcgtcgggtcgcggttttttcgtgttttttgtttagcggtttcggttagtggggttcgtcgttttaggtcgagttttcgttattcgaggtcggggcgtcgaggggagcgttgtcgagtcgttgtttacgttttcggggtgtcggagcggatattcgcgaggcgggttcgttttcgcgtatttatcgggtttttcgtgtcgtcggttcggtttttttttttttttttttttcgtcgtcgtttttttcgcggtttttcgggcggtcgtattgggcgttgggattggtttgggttaagtgtcggtagagttgggggtaggttcgcgtcgggcgggggttacggtcggtttataggttgggtattaacgggtttcggggcgtcggggcggatcgcggaggtgagcgcgattgtaggttacggtaagggacggggagagcgcggttgagagtaggcgggcggacggagggtggaggaaagttcggtcggaggaggcggcgtgagagtttcggggcggggacggggttttcggcggggtttggcgcgttcgtcgagcgcgggggtttgtttattttcgcggttggtagcggcgttggcgttggttagaggttcgtcggtgacgtgagcgttcgagttgggggagaggattagaattatttgttggagaaggggagttacgggggtcgggtagggtttaaacgttttacgtaggcggcg

SEQ ID NO: 40200 - DNA, 968 bp, Artificial Sequence
  chemically treated genomic DNA (Homo sapiens) CpG-island No: 40200
cgccgcctacgtaaaacgtttaaaccctacccgacccccgtaactccccttctccaacaaataattctaatcctctcccccaactcgaacgctcacgtcaccgacgaacctctaaccaacgccaacgccgctaccaaccgcgaaaataaacaaacccccgcgctcgacgaacgcgccaaaccccgccgaaaaccccgtccccgccccgaaactctcacgccgcctcctccgaccgaactttcctccaccctccgtccgcccgcctactctcaaccgcgctctccccgtcccttaccgtaacctacaatcgcgctcacctccgcgatccgccccgacgccccgaaacccgttaatacccaacctataaaccgaccgtaacccccgcccgacgcgaacctacccccaactctaccgacacttaacccaaaccaatcccaacgcccaatacgaccgcccgaaaaaccgcgaaaaaaacgacgacgaaaaaaaaaaaaaaaaaaaaaccgaaccgacgacacgaaaaacccgataaatacgcgaaaacgaacccgcctcgcgaatatccgctccgacaccccgaaaacgtaaacaacgactcgacaacgctcccctcgacgccccgacctcgaataacgaaaactcgacctaaaacgacgaaccccactaaccgaaaccgctaaacaaaaaacacgaaaaaaccgcgacccgacgctcgacgcaaaactcgaaacgacgaaaaaaaactcgcacccgactcccaaaccgacgaccgctaaacctcccgaaaccccgtaaaaaccgctcgaataacaaataccacaatcccctccccgccgctaacgcccgcgctccctcccgaacacccgaacgctcgaaaatttctaaaacaacgacctaactcgttttctccctttcaaattttaaaaccgcttctctacccgaattaaatttcgcccaacgcaatttct

SEQ ID NO: 40201 - DNA, 681 bp, Artificial Sequence
  chemically treated genomic DNA (Homo sapiens) CpG-island No: 40201
aagacgtcgaggtcggtgtagtagagaaatagaggataatggcgtttgtagtgttgtcgtttggagcgttttttttttttttcgttcgcgtatttattagttggggggaggggcggttagggggcgaatttttcgcgagatttaataattgtttagtttacgcgtatagggagggggcggggaaggggcgttttttagtttcgaaggagttttttggggttggaggaggggcgcgagcgcgcggtaaatcgggcgggaagaggtaaaaaaggaattgggagcgcgtcgcggcggtttttgtttttatagttgcgttgtttagggatcgatgttgcgcgaggaaaatgcgggacgtttaggtcggtgttcggtttagatttatgttcgtgtttttatagtttatattcgtgttcgaagttttttatttcgtttcgggttgtggtttgtgggttgtgggacgagttgcggcgcggtaagtgcgggtcgtttgcgttcgttgggtcgggtttacgtttcggaaattcgttgtttgtaatggttcggggcgttcgttagttaaggtcgggttcgggggcgtagttggcggttttcggtttgttttgcgtcggggcgggagtcggggaaacgcggggcgagtttgggagtattggagaatttttcgtcgagagggtataggcggtt

SEQ ID NO: 40202 - DNA, 681 bp, Artificial Sequence
  chemically treated genomic DNA (Homo sapiens) CpG-island No: 40202
aaccgcctataccctctcgacgaaaaattctccaatactcccaaactcgccccgcgtttccccgactcccgccccgacgcaaaacaaaccgaaaaccgccaactacgcccccgaacccgaccttaactaacgaacgccccgaaccattacaaacaacgaatttccgaaacgtaaacccgacccaacgaacgcaaacgacccgcacttaccgcgccgcaactcgtcccacaacccacaaaccacaacccgaaacgaaataaaaaacttcgaacacgaatataaactataaaaacacgaacataaatctaaaccgaacaccgacctaaacgtcccgcattttcctcgcgcaacatcgatccctaaacaacgcaactataaaaacaaaaaccgccgcgacgcgctcccaattccttttttacctcttcccgcccgatttaccgcgcgctcgcgcccctcctccaaccccaaaaaactccttcgaaactaaaaaacgccccttccccgccccctccctatacgcgtaaactaaacaattattaaatctcgcgaaaaattcgccccctaaccgcccctccccccaactaataaatacgcgaacgaaaaaaaaaaaaaacgctccaaacgacaacactacaaacgccattatcctctatttctctactacaccgacctcgacgtctt

SEQ ID NO: 40203 - DNA, 681 bp, Artificial Sequence
  chemically treated genomic DNA (Homo sapiens) CpG-island No: 40203
aatcgtttgtgttttttcggcgagaagttttttagtatttttaggttcgtttcgcgttttttcggttttcgtttcggcgtaaggtaggtcgagaatcgttagttgcgttttcgggttcggttttgattgacgggcgtttcggattattataaataacgggttttcgaagcgtgggttcggtttagcggacgtagacggttcgtatttatcgcgtcgtagttcgttttatagtttatagattatagttcggggcggggtaaggggtttcgggtacgagtgtgggttgtgaaaatacgggtataagtttgggtcgagtatcgatttgggcgtttcgtatttttttcgcgtaatatcggtttttgggtagcgtaattgtaaggataggaatcgtcgcggcgcgtttttagttttttttttattttttttcgttcgatttgtcgcgcgttcgcgttttttttttaattttaaaggattttttcggggttggaaaacgtttttttttcgttttttttttgtgcgcgtgaattaggtagttgttagatttcgcgagaggttcgttttttagtcgtttttttttttagttagtgagtgcgcgaacgagaaaggaggagggcgttttaggcgatagtattgtagacgttattattttttgtttttttgttgtatcgatttcgacgtttt

SEQ ID NO: 40204 - DNA, 681 bp, Artificial Sequence
  chemically treated genomic DNA (Homo sapiens) CpG-island No: 40204
aaaacgtcgaaatcgatacaacaaaaaaacaaaaaataataacgtctacaatactatcgcctaaaacgccctcctcctttctcgttcgcgcactcactaactaaaaaaaaaaacgactaaaaaacgaacctctcgcgaaatctaacaactacctaattcacgcgcacaaaaaaaaaacgaaaaaaaaacgttttccaaccccgaaaaaatcctttaaaattaaaaaaaaaacgcgaacgcgcgacaaatcgaacgaaaaaaaataaaaaaaaaactaaaaacgcgccgcgacgattcctatccttacaattacgctacccaaaaaccgatattacgcgaaaaaaatacgaaacgcccaaatcgatactcgacccaaacttatacccgtattttcacaacccacactcgtacccgaaaccccttaccccgccccgaactataatctataaactataaaacgaactacgacgcgataaatacgaaccgtctacgtccgctaaaccgaacccacgcttcgaaaacccgttatttataataatccgaaacgcccgtcaatcaaaaccgaacccgaaaacgcaactaacgattctcgacctaccttacgccgaaacgaaaaccgaaaaaacgcgaaacgaacctaaaaatactaaaaaacttctcgccgaaaaaacacaaacgatt

SEQ ID NO: 40205 - DNA, 870 bp, Artificial Sequence
  chemically treated genomic DNA (Homo sapiens) CpG-island No: 40205
ttttgggtggtttacgcgtttggtttgggtaggaatttttgtgggtagcgaggcgtatttaggtagcgttgcgggtgaatttgcgtgggatgagggtggattttttttaggattgcggtgtattttaggtcggggtgaaggtgttttatagtcgcggcgtagggaattttttttaggatgggggagcgggtcgggcggcgtcggttagggaggggaagtttaacgggggttcggagaggttcgggggattcggacggagagaagtcgggtcgcggttgcggaggttcggtcggttaagggattttcgcgacgtttagcgttgcgagttgcgcggcgttgcggtttttttcgtttcgggggaatttgttgtcggcgaaataggcgggcggtggcgacgatggagaagtttttttcgtttttgtttggttgtacggtagtttttttattttaggtacgtttcgcggcgcggttttttttttcgttttttcgtttaaaataaatagaatacgtcgtcgttaattttagtttgttaacggcgagtacggtcgtttttcgtgtcgttttcgggagtcgaggcgcggtttcgtcgttcggggaggaggaggcggagggggaggaggttaatatggcggcgcgtagggttgggtcgggtcgtagtcgcgtttgagcgttttatcgtattagttcggttcgtaggatttaagttcgtatttagtttggttcggttgttgcggagtattcggggtaggaacgtaggggttaatttgggcgcggaggcggcgcggagggtgcgtcgcgcggttcgttaggttcgggattcgtagtttcgtcgtgcgttggtcggggcggttaggaggtttaagttatgga

SEQ ID NO: 40206 - DNA, 870 bp, Artificial Sequence
  chemically treated genomic DNA (Homo sapiens) CpG-island No: 40206
tccataacttaaacctcctaaccgccccgaccaacgcacgacgaaactacgaatcccgaacctaacgaaccgcgcgacgcaccctccgcgccgcctccgcgcccaaattaacccctacgttcctaccccgaatactccgcaacaaccgaaccaaactaaatacgaacttaaatcctacgaaccgaactaatacgataaaacgctcaaacgcgactacgacccgacccaaccctacgcgccgccatattaacctcctccccctccgcctcctcctccccgaacgacgaaaccgcgcctcgactcccgaaaacgacacgaaaaacgaccgtactcgccgttaacaaactaaaattaacgacgacgtattctatttattttaaacgaaaaaacgaaaaaaaaaaccgcgccgcgaaacgtacctaaaataaaaaaactaccgtacaaccaaacaaaaacgaaaaaaacttctccatcgtcgccaccgcccgcctatttcgccgacaacaaattcccccgaaacgaaaaaaaccgcaacgccgcgcaactcgcaacgctaaacgtcgcgaaaatcccttaaccgaccgaacctccgcaaccgcgacccgacttctctccgtccgaatcccccgaacctctccgaacccccgttaaacttcccctccctaaccgacgccgcccgacccgctcccccatcctaaaaaaaattccctacgccgcgactataaaacaccttcaccccgacctaaaatacaccgcaatcctaaaaaaaatccaccctcatcccacgcaaattcacccgcaacgctacctaaatacgcctcgctacccacaaaaattcctacccaaaccaaacgcgtaaaccacccaaaa

SEQ ID NO: 40207 - DNA, 870 bp, Artificial Sequence
  chemically treated genomic DNA (Homo sapiens) CpG-island No: 40207
tttatggtttgggttttttggtcgtttcggttagcgtacggcgaagttacgggtttcgggtttggcgggtcgcgcggcgtatttttcgcgtcgttttcgcgtttaggttggtttttgcgtttttgtttcgggtgtttcgtagtagtcgggttaggttgggtgcgggtttgggttttgcgagtcgagttagtgcggtgaggcgtttaggcgcggttgcggttcggtttagttttgcgcgtcgttatgttggtttttttttttttcgttttttttttttcgggcggcggggtcgcgtttcggttttcggaagcggtacgggaggcgatcgtgttcgtcgttggtaggttagggttggcggcggcgtattttgtttgttttaaacgaaggagcggagggaggggtcgcgtcgcggagcgtgtttaaggtgaaagggttgtcgtgtagttaggtagaggcgaggaaggtttttttatcgtcgttatcgttcgtttgtttcgtcggtaataggttttttcgggacgggaggggtcgtagcgtcgcgtagttcgtagcgttgaacgtcgcggaaattttttggtcggtcgagttttcgtagtcgcgattcggttttttttcgttcgagtttttcgagttttttcgaattttcgttggattttttttttttggtcggcgtcgttcgattcgtttttttattttagagggaattttttgcgtcgcggttgtgaggtatttttatttcggtttgaaatgtatcgtagttttgaaggaaatttatttttattttacgtagatttattcgtaacgttgtttgaatacgtttcgttgtttatagaaatttttgtttaaattagacgcgtggattatttaaga

SEQ ID NO: 40208 - DNA, 870 bp, Artificial Sequence
  chemically treated genomic DNA (Homo sapiens) CpG-island No: 40208
tcttaaataatccacgcgtctaatttaaacaaaaatttctataaacaacgaaacgtattcaaacaacgttacgaataaatctacgtaaaataaaaataaatttccttcaaaactacgatacatttcaaaccgaaataaaaatacctcacaaccgcgacgcaaaaaattccctctaaaataaaaaaacgaatcgaacgacgccgaccaaaaaaaaaaaatccaacgaaaattcgaaaaaactcgaaaaactcgaacgaaaaaaaaccgaatcgcgactacgaaaactcgaccgaccaaaaaatttccgcgacgttcaacgctacgaactacgcgacgctacgacccctcccgtcccgaaaaaacctattaccgacgaaacaaacgaacgataacgacgataaaaaaaccttcctcgcctctacctaactacacgacaaccctttcaccttaaacacgctccgcgacgcgacccctccctccgctccttcgtttaaaacaaacaaaatacgccgccgccaaccctaacctaccaacgacgaacacgatcgcctcccgtaccgcttccgaaaaccgaaacgcgaccccgccgcccgaaaaaaaaaaaacgaaaaaaaaaaaaaccaacataacgacgcgcaaaactaaaccgaaccgcaaccgcgcctaaacgcctcaccgcactaactcgactcgcaaaacccaaacccgcacccaacctaacccgactactacgaaacacccgaaacaaaaacgcaaaaaccaacctaaacgcgaaaacgacgcgaaaaatacgccgcgcgacccgccaaacccgaaacccgtaacttcgccgtacgctaaccgaaacgaccaaaaaacccaaaccataaa

SEQ ID NO: 40209 - DNA, 687 bp, Artificial Sequence
  chemically treated genomic DNA (Homo sapiens) CpG-island No: 40209
gggggtgttgggggatgcggatgggtcgtttcgcgttcgaatattttggaagttcgttattcgaggcgtggattcgtgtcggcgttttgtagtttagtcggtttggttatgttttatttttcgtcgttgtagtttcgataggaacgttttcggttggttttcgggtttcggaaaagtcgttaggcgcgtgattaaaggattcggggaaatgggtcgggttttagtattcggacgtagttaattcggtagcggaaagtcggtggtttggagatttttggagtcgttaattcggaggcgggggtgggcggtgcgaaggcggggatagcggggtttgtagggttcgttcggcggcggtagggggtagtcgagggttgcgtagtgggggaggagaacgcgacgcggggtcggacggggtagggcggggcgcgcgtagtttttcggcggtttttggttcgttcgcgtttggagtttcgattttgggaggttttcggcgtttattttatttatttttttcgttgtagttagaatagggtcgcgttacgttttaacgttgagtttaggtttttcgcggtaagattttgtttcgggtttattcggttttcgtttgtgtttgttttttggttttcgggttgtgttcggttggtagagtacggtaggtttgggttatcgagggttttggtacgttta

SEQ ID NO: 40210 - DNA, 687 bp, Artificial Sequence
  chemically treated genomic DNA (Homo sapiens) CpG-island No: 40210
taaacgtaccaaaaccctcgataacccaaacctaccgtactctaccaaccgaacacaacccgaaaaccaaaaaacaaacacaaacgaaaaccgaataaacccgaaacaaaatcttaccgcgaaaaacctaaactcaacgttaaaacgtaacgcgaccctattctaactacaacgaaaaaaataaataaaataaacgccgaaaacctcccaaaatcgaaactccaaacgcgaacgaaccaaaaaccgccgaaaaactacgcgcgccccgccctaccccgtccgaccccgcgtcgcgttctcctcccccactacgcaaccctcgactaccccctaccgccgccgaacgaaccctacaaaccccgctatccccgccttcgcaccgcccacccccgcctccgaattaacgactccaaaaatctccaaaccaccgactttccgctaccgaattaactacgtccgaatactaaaacccgacccatttccccgaatcctttaatcacgcgcctaacgacttttccgaaacccgaaaaccaaccgaaaacgttcctatcgaaactacaacgacgaaaaataaaacataaccaaaccgactaaactacaaaacgccgacacgaatccacgcctcgaataacgaacttccaaaatattcgaacgcgaaacgacccatccgcatcccccaacaccccc

SEQ ID NO: 40211 - DNA, 687 bp, Artificial Sequence
  chemically treated genomic DNA (Homo sapiens) CpG-island No: 40211
tgggcgtgttagggttttcggtagtttagatttgtcgtattttattagtcgagtatagttcgaaggttagggaataaatatagacggaggtcgagtgggttcggagtagggttttgtcgcgaagggtttgggtttaacgttagagcgtggcgcgattttattttggttgtaacgagaggggtgaatgaagtgggcgtcggggattttttagaatcggagttttagacgcgggcgggttaggggtcgtcggaaaattgcgcgcgtttcgttttatttcgttcggtttcgcgtcgcgttttttttttttattgcgtagttttcggttgttttttgtcgtcgtcgggcggattttgtaagtttcgttgttttcgttttcgtatcgtttattttcgttttcggattggcggttttagaaatttttaggttatcggtttttcgttatcggattggttgcgttcgggtgttgaggttcggtttattttttcgggttttttgattacgcgtttgacggttttttcggggttcgggagttaatcgagggcgtttttgtcggggttgtagcggcgggaggtaaggtatggttaggtcggttgggttgtagagcgtcggtacgggtttacgtttcgggtgacgggtttttaggatgttcgggcgcggggcggtttattcgtattttttaatattttt

SEQ ID NO: 40212 - DNA, 687 bp, Artificial Sequence
  chemically treated genomic DNA (Homo sapiens) CpG-island No: 40212
aaaaatattaaaaaatacgaataaaccgccccgcgcccgaacatcctaaaaacccgtcacccgaaacgtaaacccgtaccgacgctctacaacccaaccgacctaaccataccttacctcccgccgctacaaccccgacaaaaacgccctcgattaactcccgaaccccgaaaaaaccgtcaaacgcgtaatcaaaaaacccgaaaaaataaaccgaacctcaacacccgaacgcaaccaatccgataacgaaaaaccgataacctaaaaatttctaaaaccgccaatccgaaaacgaaaataaacgatacgaaaacgaaaacaacgaaacttacaaaatccgcccgacgacgacaaaaaacaaccgaaaactacgcaataaaaaaaaaaaacgcgacgcgaaaccgaacgaaataaaacgaaacgcgcgcaattttccgacgacccctaacccgcccgcgtctaaaactccgattctaaaaaatccccgacgcccacttcattcacccctctcgttacaaccaaaataaaatcgcgccacgctctaacgttaaacccaaacccttcgcgacaaaaccctactccgaacccactcgacctccgtctatatttattccctaaccttcgaactatactcgactaataaaatacgacaaatctaaactaccgaaaaccctaacacgccca

SEQ ID NO: 40213 - DNA, 663 bp, Artificial Sequence
  chemically treated genomic DNA (Homo sapiens) CpG-island No: 40213
tagcgggtagatgtttcgagttgtcgtcgtcgtcgtcgtcgattcggtcggtggcggtgtgggaggtgggcgattagttcggggtcgttgagtgtgacggacgtaattgggggcgtcgggggtttcgtacggattatgtattttttgagcggttggtttaagaggttgttgtgttttttggggagttcggtcgaggcgtttttttacgtttagttcgattcgtagagggtttttttcgtcgtgttggtcgcggttcgttttagtatttggtatagtcgagtaagtagagtcgttcgtcgtttttcgtcgttgttttttcggtttttcggcgtcgttttatttttaatttttatttagagtttaggatttttgttttttcgtgttagatttatttgttttcgtagttcgcgttttcgttttatcgaattggtcgtaggtattcgtcggttgtaggtacgttttttagcgggcggttcggggtggatgaagtcgttgttgtcgaaaatttttgagttttttcgcgttggatcgacggtcgcggcgtgtagatttcgtacgtttttcggtcgagtttagatttgtttttttttttttttttttatttttcgagggataaatttgtttaaattttttataattagaaattcggtcgttgtggtgttt

SEQ ID NO: 40214 - DNA, 663 bp, Artificial Sequence
  chemically treated genomic DNA (Homo sapiens) CpG-island No: 40214
aaacaccacaacgaccgaatttctaattataaaaaatttaaacaaatttatccctcgaaaaataaaaaaaaaaaaaaaaaaacaaatctaaactcgaccgaaaaacgtacgaaatctacacgccgcgaccgtcgatccaacgcgaaaaaactcaaaaattttcgacaacaacgacttcatccaccccgaaccgcccgctaaaaaacgtacctacaaccgacgaatacctacgaccaattcgataaaacgaaaacgcgaactacgaaaacaaataaatctaacacgaaaaaacaaaaatcctaaactctaaataaaaattaaaaataaaacgacgccgaaaaaccgaaaaaacaacgacgaaaaacgacgaacgactctacttactcgactataccaaatactaaaacgaaccgcgaccaacacgacgaaaaaaaccctctacgaatcgaactaaacgtaaaaaaacgcctcgaccgaactccccaaaaaacacaacaacctcttaaaccaaccgctcaaaaaatacataatccgtacgaaacccccgacgcccccaattacgtccgtcacactcaacgaccccgaactaatcgcccacctcccacaccgccaccgaccgaatcgacgacgacgacgacgacaactcgaaacatctacccgcta

SEQ ID NO: 40215 - DNA, 663 bp, Artificial Sequence
  chemically treated genomic DNA (Homo sapiens) CpG-island No: 40215
gggtattatagcggtcggatttttaattgtggaaagtttaaataaatttgtttttcggggaatgggggaagggagagaagaataagtttgggttcggtcggggagcgtgcggagtttgtacgtcgcggtcgtcggtttaacgcggggaggtttagggattttcggtagtagcgattttatttatttcggatcgttcgttggaggacgtgtttgtagtcggcgggtatttgcggttaattcggtggaacgaggacgcggattgcgaaggtaggtgggtttggtacgaaggggtaggagttttaggttttgggtggaagttgggggtgggacggcgtcgggaggtcggggaggtagcggcgaaaggcggcgggcggttttatttattcggttgtattagatgttgaggcgggtcgcggttagtacggcgaagaaagttttttgcgggtcggattgaacgtggaaaggcgtttcggtcgggttttttagagggtatagtagttttttgggttagtcgtttagaaaatatatggttcgtgcggagttttcggcgtttttagttgcgttcgttatatttagcggtttcgggttggtcgtttattttttatatcgttatcggtcgagtcggcggcggcggcggcggtagttcggggtatttgttcgttg

SEQ ID NO: 40216 - DNA, 663 bp, Artificial Sequence
  chemically treated genomic DNA (Homo sapiens) CpG-island No: 40216
caacgaacaaataccccgaactaccgccgccgccgccgccgactcgaccgataacgatataaaaaataaacgaccaacccgaaaccgctaaatataacgaacgcaactaaaaacgccgaaaactccgcacgaaccatatattttctaaacgactaacccaaaaaactactataccctctaaaaaacccgaccgaaacgcctttccacgttcaatccgacccgcaaaaaactttcttcgccgtactaaccgcgacccgcctcaacatctaatacaaccgaataaataaaaccgcccgccgcctttcgccgctacctccccgacctcccgacgccgtcccacccccaacttccacccaaaacctaaaactcctaccccttcgtaccaaacccacctaccttcgcaatccgcgtcctcgttccaccgaattaaccgcaaatacccgccgactacaaacacgtcctccaacgaacgatccgaaataaataaaatcgctactaccgaaaatccctaaacctccccgcgttaaaccgacgaccgcgacgtacaaactccgcacgctccccgaccgaacccaaacttattcttctctcccttcccccattccccgaaaaacaaatttatttaaactttccacaattaaaaatccgaccgctataataccc

SEQ ID NO: 40217 - DNA, 642 bp, Artificial Sequence
  chemically treated genomic DNA (Homo sapiens) CpG-island No: 40217
tttcgcgcgttttcgttcgtatgtgtcgttaggttcgttttcgttcggtcgttcgttcgttcggtgggtcgcggtggtcgcgggttgcgttgcgcgggtcgggtttggcgggtcgggggttgcgcgcgttcgcgagggcgttcgacgcgggttgaggggcgttggcgtgtgttcgtaggcggttttgcgcgggggacggcgcgtttttggatatcgtcggttttaagatgagcgatttggatttcgaggtgttgtttttgtcgtcgcgttatcgttttcgggatttgttgttgggcgattcgtttttttagaacgacgataggtagggatcgggcgcggggtgggggttggggtcgtcgtttcggcgtcgtcgtacgttcggagttgttcgcggtgttgacggtcggtttcgcgcgttttcgtagtcgtcggcgttttttaatttttttcggtttttggggacgtagaagtttcggagggggtgcgggtagggggaagtattttttcgggagggggttttcggaggagggcgcgggatgttcggagttgcggagttttttagagttcgatttggggcgcggaggcggagggcggtttggtttttcggtgtttgtttttaatttttagtattttagttttttt

SEQ ID NO: 40218 - DNA, 642 bp, Artificial Sequence
  chemically treated genomic DNA (Homo sapiens) CpG-island No: 40218
aaaaaaactaaaatactaaaaattaaaaacaaacaccgaaaaaccaaaccgccctccgcctccgcgccccaaatcgaactctaaaaaactccgcaactccgaacatcccgcgccctcctccgaaaaccccctcccgaaaaaatacttccccctacccgcaccccctccgaaacttctacgtccccaaaaaccgaaaaaaattaaaaaacgccgacgactacgaaaacgcgcgaaaccgaccgtcaacaccgcgaacaactccgaacgtacgacgacgccgaaacgacgaccccaacccccaccccgcgcccgatccctacctatcgtcgttctaaaaaaacgaatcgcccaacaacaaatcccgaaaacgataacgcgacgacaaaaacaacacctcgaaatccaaatcgctcatcttaaaaccgacgatatccaaaaacgcgccgtcccccgcgcaaaaccgcctacgaacacacgccaacgcccctcaacccgcgtcgaacgccctcgcgaacgcgcgcaacccccgacccgccaaacccgacccgcgcaacgcaacccgcgaccaccgcgacccaccgaacgaacgaacgaccgaacgaaaacgaacctaacgacacatacgaacgaaaacgcgcgaaa

SEQ ID NO: 40219 - DNA, 642 bp, Artificial Sequence
  chemically treated genomic DNA (Homo sapiens) CpG-island No: 40219
agaaaaattggggtgttgggggttgggagtagatatcggaaggttaggtcgtttttcgttttcgcgttttaagtcgggttttggaagatttcgtagtttcgagtatttcgcgttttttttcggagattttttttcgagaagatgtttttttttgttcgtatttttttcgaaatttttgcgtttttagaagtcgggaaaagttgaagggcgtcggcggttgcgggggcgcgcgggatcggtcgttagtatcgcggatagtttcgggcgtgcggcggcgtcgggacggcgattttagtttttatttcgcgttcggtttttatttgtcgtcgttttggaaggacgggtcgtttagtagtaggtttcggaagcggtagcgcggcggtaagggtagtatttcggagtttaggtcgtttattttgaagtcggcggtgtttaggagcgcgtcgtttttcgcgtagggtcgtttgcgggtatacgttagcgttttttagttcgcgtcgggcgttttcgcggacgcgcgtagttttcggttcgttaggttcggttcgcgtagcgtagttcgcggttatcgcgatttatcgggcgggcgggcggtcgggcgggggcgggtttggcggtatatgcgggcgggggcgcgcggga

SEQ ID NO: 40220 - DNA, 642 bp, Artificial Sequence
  chemically treated genomic DNA (Homo sapiens) CpG-island No: 40220
tcccgcgcgcccccgcccgcatataccgccaaacccgcccccgcccgaccgcccgcccgcccgataaatcgcgataaccgcgaactacgctacgcgaaccgaacctaacgaaccgaaaactacgcgcgtccgcgaaaacgcccgacgcgaactaaaaaacgctaacgtatacccgcaaacgaccctacgcgaaaaacgacgcgctcctaaacaccgccgacttcaaaataaacgacctaaactccgaaatactacccttaccgccgcgctaccgcttccgaaacctactactaaacgacccgtccttccaaaacgacgacaaataaaaaccgaacgcgaaataaaaactaaaatcgccgtcccgacgccgccgcacgcccgaaactatccgcgatactaacgaccgatcccgcgcgcccccgcaaccgccgacgcccttcaacttttcccgacttctaaaaacgcaaaaatttcgaaaaaaatacgaacaaaaaaaaacatcttctcgaaaaaaaatctccgaaaaaaaacgcgaaatactcgaaactacgaaatcttccaaaacccgacttaaaacgcgaaaacgaaaaacgacctaaccttccgatatctactcccaacccccaacaccccaatttttct

SEQ ID NO: 40221 - DNA, 537 bp, Artificial Sequence
  chemically treated genomic DNA (Homo sapiens) CpG-island No: 40221
taacgtcgtgattgggaaaattttggcgttatttaatttaatcgttttgtaggatatgtttttttggttagttggcgtgatatcgaagcgggttttattcgtcggtttttcgatttgtcgtgttcgtcgtttagcggtttcggttagcggggttcgtcgttttagggcgagttttcgttattcgaggtcggggcgtcgaggggagcgttgtcgagtcgttgtttacgttttcggggtgtcggagcggatattcgcgaggcgggttcgttttcgcgtatttatcgggtttttcgtgtcgtcggttcggtttttttttttttttttttttcgtcgtcgtttttttcgcggtttttcgggcggtcgtattgggcgttgggattggtttgggttaagtgtcggtagagttgggggtaggttcgcgtcgggcgggggtcgcggtcggtttataggttgggtattaacgggtttcggggcgtcggggcggatcgcggaggtgagcgcggttgtaggttgcggtgaggggcggggagagcgcgg

SEQ ID NO: 40222 - DNA, 537 bp, Artificial Sequence
  chemically treated genomic DNA (Homo sapiens) CpG-island No: 40222
ccgcgctctccccgcccctcaccgcaacctacaaccgcgctcacctccgcgatccgccccgacgccccgaaacccgttaatacccaacctataaaccgaccgcgacccccgcccgacgcgaacctacccccaactctaccgacacttaacccaaaccaatcccaacgcccaatacgaccgcccgaaaaaccgcgaaaaaaacgacgacgaaaaaaaaaaaaaaaaaaaaaccgaaccgacgacacgaaaaacccgataaatacgcgaaaacgaacccgcctcgcgaatatccgctccgacaccccgaaaacgtaaacaacgactcgacaacgctcccctcgacgccccgacctcgaataacgaaaactcgccctaaaacgacgaaccccgctaaccgaaaccgctaaacgacgaacacgacaaatcgaaaaaccgacgaataaaacccgcttcgatatcacgccaactaaccaaaaaaacatatcctacaaaacgattaaattaaataacgccaaaattttcccaatcacgacgtta

SEQ ID NO: 40223 - DNA, 537 bp, Artificial Sequence
  chemically treated genomic DNA (Homo sapiens) CpG-island No: 40223
tcgcgtttttttcgttttttatcgtagtttgtagtcgcgtttattttcgcggttcgtttcggcgtttcgggattcgttagtgtttagtttgtgggtcgatcgcgattttcgttcggcgcgagtttgtttttagttttgtcgatatttgatttagattagttttaacgtttagtgcggtcgttcggggagtcgcgggagaggcggcggcggggggaggagggagaggagggtcgagtcggcggtacgggaggttcggtgagtacgcggaggcgggttcgtttcgcgggtgttcgtttcggtatttcggaggcgtaggtagcggttcgatagcgtttttttcggcgtttcggtttcgggtggcggggattcgttttgaggcgacgggtttcgttgatcggagtcgttgggcgacgggtacggtaggtcggagggtcgacgggtggggttcgtttcggtattacgttagttggttaaaggggtatgttttgtaaggcgattaagttgggtaacgttagggtttttttagttacgacgttg

SEQ ID NO: 40224 - DNA, 537 bp, Artificial Sequence
  chemically treated genomic DNA (Homo sapiens) CpG-island No: 40224
caacgtcgtaactaaaaaaaccctaacgttacccaacttaatcgccttacaaaacatacccctttaaccaactaacgtaataccgaaacgaaccccacccgtcgaccctccgacctaccgtacccgtcgcccaacgactccgatcaacgaaacccgtcgcctcaaaacgaatccccgccacccgaaaccgaaacgccgaaaaaaacgctatcgaaccgctacctacgcctccgaaataccgaaacgaacacccgcgaaacgaacccgcctccgcgtactcaccgaacctcccgtaccgccgactcgaccctcctctccctcctccccccgccgccgcctctcccgcgactccccgaacgaccgcactaaacgttaaaactaatctaaatcaaatatcgacaaaactaaaaacaaactcgcgccgaacgaaaatcgcgatcgacccacaaactaaacactaacgaatcccgaaacgccgaaacgaaccgcgaaaataaacgcgactacaaactacgataaaaaacgaaaaaaacgcga

SEQ ID NO: 40225 - DNA, 554 bp, Artificial Sequence
  chemically treated genomic DNA (Homo sapiens) CpG-island No: 40225
gaggcgtagggcgagggggtttcggtgaataatttttttcgttcggcgaatttcggcgggcggtttggggtgggcgtcgttggcggtatttatcgcgcgtagtggagagggcgtttcgacgcggtgcgggcgggcgggcgggtcggtgcgggttcgacgaggtcgggttgattgcggcgggtacgttgttgtttttgtcgttgtcgttgttttcgttttttgggttgtcgcggttgttgtttgcgtcgggaggatcggtttttttttttttttgggtcgggttttttttttgttttcgttcgggttttcgcgtcgttgcgtgggcgcgtgggggcgtcgaggcgcgacgttgggttacgcgggcgtatatattcggcggttggacgtagggcgcggggttttggtttagtagttgtcgtcgcgtcgttttttgagtttgtagtcgagtagagcgcgtttattttcgtcggttttggaggttagggtttagttttttttcgatttatcgatatcgcggatttttttttttttcggggtagtatattttgtttgta

SEQ ID NO: 40226 - DNA, 554 bp, Artificial Sequence
  chemically treated genomic DNA (Homo sapiens) CpG-island No: 40226
tacaaacaaaatatactaccccgaaaaaaaaaaaaatccgcgatatcgataaatcgaaaaaaaactaaaccctaacctccaaaaccgacgaaaataaacgcgctctactcgactacaaactcaaaaaacgacgcgacgacaactactaaaccaaaaccccgcgccctacgtccaaccgccgaatatatacgcccgcgtaacccaacgtcgcgcctcgacgcccccacgcgcccacgcaacgacgcgaaaacccgaacgaaaacaaaaaaaaaacccgacccaaaaaaaaaaaaaaaccgatcctcccgacgcaaacaacaaccgcgacaacccaaaaaacgaaaacaacgacaacgacaaaaacaacaacgtacccgccgcaatcaacccgacctcgtcgaacccgcaccgacccgcccgcccgcccgcaccgcgtcgaaacgccctctccactacgcgcgataaataccgccaacgacgcccaccccaaaccgcccgccgaaattcgccgaacgaaaaaaattattcaccgaaaccccctcgccctacgcctc

SEQ ID NO: 40227 - DNA, 554 bp, Artificial Sequence
  chemically treated genomic DNA (Homo sapiens) CpG-island No: 40227
tgtaggtaggatgtgttgtttcggggagggaggaggttcgcggtgtcggtgggtcgggaggaggttgggttttggtttttaggatcggcgagagtgagcgcgttttgttcggttgtaggtttaggaagcggcgcggcggtagttgttgggttagagtttcgcgttttgcgtttagtcgtcgggtgtgtgcgttcgcgtagtttagcgtcgcgtttcggcgtttttacgcgtttacgtagcggcgcggggattcgggcgggggtagagggagggttcggtttagggaggagaaggggtcggttttttcggcgtaggtagtagtcgcggtagtttaggaggcggaggtagcggtaacggtagagatagtaacgtgttcgtcgtagttagttcggtttcgtcggattcgtatcggttcgttcgttcgttcgtatcgcgtcggggcgttttttttattgcgcgcggtgagtatcgttagcggcgtttattttaggtcgttcgtcgggattcgtcgggcggggggagttgtttatcgggattttttcgttttgcgtttt

SEQ ID NO: 40228 - DNA, 554 bp, Artificial Sequence
  chemically treated genomic DNA (Homo sapiens) CpG-island No: 40228
aaaacgcaaaacgaaaaaatcccgataaacaactccccccgcccgacgaatcccgacgaacgacctaaaataaacgccgctaacgatactcaccgcgcgcaataaaaaaaacgccccgacgcgatacgaacgaacgaacgaaccgatacgaatccgacgaaaccgaactaactacgacgaacacgttactatctctaccgttaccgctacctccgcctcctaaactaccgcgactactacctacgccgaaaaaaccgaccccttctcctccctaaaccgaaccctccctctacccccgcccgaatccccgcgccgctacgtaaacgcgtaaaaacgccgaaacgcgacgctaaactacgcgaacgcacacacccgacgactaaacgcaaaacgcgaaactctaacccaacaactaccgccgcgccgcttcctaaacctacaaccgaacaaaacgcgctcactctcgccgatcctaaaaaccaaaacccaacctcctcccgacccaccgacaccgcgaacctcctccctccccgaaacaacacatcctacctaca

SEQ ID NO: 40229 - DNA, 549 bp, Artificial Sequence
  chemically treated genomic DNA (Homo sapiens) CpG-island No: 40229
tcgtgagggtcgcgcggtacgcgtttagtttttcgggacgtttttttttttatttttattttcggtttttagttttttattatttattttcgggcggggatcggaagtgtagtcgttttcgtcgggagtcgcggagttgagggacgcgcggagatgacgtaggtagtatcggaagtcgtttttttgtgaggttgcggatcgggagtagcggtcgtaggttcgggtttgtatgcgagtcggggttcggtcggggaggggatttttaggcgttcgcggttttgatgattcgtcgcgttttggttgtttttttttttttgtaggcgttatggttgcggagcggattcgttcgttgtaaggttttgacggttcgagcgtgtttagtatttgtgaattcggcgcgaggttttcgggtttcggggcgttcgtttaggttagtatcgcgcggaattcgatttcgagagtaagggatttgggagtaacgaatgggttgatgggaattggattttagagacgggaaaatagggttttggagtttcggttttatattgt

SEQ ID NO: 40230 - DNA, 549 bp, Artificial Sequence
  chemically treated genomic DNA (Homo sapiens) CpG-island No: 40230
acaatataaaaccgaaactccaaaaccctattttcccgtctctaaaatccaattcccatcaacccattcgttactcccaaatcccttactctcgaaatcgaattccgcgcgatactaacctaaacgaacgccccgaaacccgaaaacctcgcgccgaattcacaaatactaaacacgctcgaaccgtcaaaaccttacaacgaacgaatccgctccgcaaccataacgcctacaaaaaaaaaaaaacaaccaaaacgcgacgaatcatcaaaaccgcgaacgcctaaaaatcccctccccgaccgaaccccgactcgcatacaaacccgaacctacgaccgctactcccgatccgcaacctcacaaaaaaacgacttccgatactacctacgtcatctccgcgcgtccctcaactccgcgactcccgacgaaaacgactacacttccgatccccgcccgaaaataaataataaaaaactaaaaaccgaaaataaaaataaaaaaaaaaacgtcccgaaaaactaaacgcgtaccgcgcgaccctcacga

SEQ ID NO: 40231 - DNA, 549 bp, Artificial Sequence
  chemically treated genomic DNA (Homo sapiens) CpG-island No: 40231
gtagtatgaggtcggaattttaaaattttgttttttcgtttttaaaatttagtttttattaatttattcgttgtttttaggttttttgttttcggaatcgggtttcgcgcggtattgatttgagcgagcgtttcggggttcgggaatttcgcgtcgggtttataggtattaggtacgttcggatcgttagagttttgtagcgggcgggttcgtttcgtagttatggcgtttgtagggaaagaaaaatagttaaggcgcggcgggttattagagtcgcgggcgtttaagagtttttttttcgatcgggtttcggttcgtatatagattcggatttgcggtcgttgttttcggttcgtagttttataggggagcggttttcggtgttgtttgcgttattttcgcgcgttttttagtttcgcggttttcggcggaagcggttgtattttcggttttcgttcgaaggtgggtggtgggaggttggaggtcgggagtaggggtggggagaagagcgtttcgggaagttgaacgcgtgtcgcgcggtttttacgg

SEQ ID NO: 40232 - DNA, 549 bp, Artificial Sequence
  chemically treated genomic DNA (Homo sapiens) CpG-island No: 40232
ccgtaaaaaccgcgcgacacgcgttcaacttcccgaaacgctcttctccccacccctactcccgacctccaacctcccaccacccaccttcgaacgaaaaccgaaaatacaaccgcttccgccgaaaaccgcgaaactaaaaaacgcgcgaaaataacgcaaacaacaccgaaaaccgctcccctataaaactacgaaccgaaaacaacgaccgcaaatccgaatctatatacgaaccgaaacccgatcgaaaaaaaaactcttaaacgcccgcgactctaataacccgccgcgccttaactatttttctttccctacaaacgccataactacgaaacgaacccgcccgctacaaaactctaacgatccgaacgtacctaatacctataaacccgacgcgaaattcccgaaccccgaaacgctcgctcaaatcaataccgcgcgaaacccgattccgaaaacaaaaaacctaaaaacaacgaataaattaataaaaactaaattttaaaaacgaaaaaacaaaattttaaaattccgacctcatactac

SEQ ID NO: 40233 - DNA, 902 bp, Artificial Sequence
  chemically treated genomic DNA (Homo sapiens) CpG-island No: 40233
cggggcgaggagattcgtagaatgtttgattagaggttattcgcgcgttttggacggtggtcgtatttttagggtttgagtttcggagtcgtagttttgtcgtagagcgtttggagtcgcgagtagttagtagttcggcgaagcgtatagtttcggcgatagttagtttcgcggtttttgttttcgtttttttcggtcgtttcgggaaggggcggagacgaggaggagttgggacggtcgtcgcgttttcgggcgtattaagttttttaaaagtcgcgggttttgatagttttgtaggtagtcgtcgcggtttcggatttttagtttcgtatttttagttggcgagtcggtttcgggtgcggcgaggtttagttttttcggattgcgcgtcggatttcgggacgcgttttatgcggtcgtttagtatgttcgggtattttttgttcgtatttattttcgagtttttttcggattatttattgtttaaggatattaaattggcggtgttgggcgtcggtcgcgtgggtaagagcggtgagtgcggcggggattttcgggcggtttcgtttttcggtttcggtcgcgattattgggggcgttgcggagagagggcgtttcggtcgaagtagagggcgcgggtgtaggtagaatcgggttgttttcgcgttgggtgggtttcggttcgtttcggtttgtttttttggcgttttttggtgtatttatttttgggatttcggcgggattggcgtttgttcggggatggggtgcgggagaggtgtttcgttagtcgtattcgcggttaagttcgcggtattacggttttgcggagtttttggaagcgagtagtgtttacggttttgtattttttattttttttagtttgttcgaggtgtttgggtttg

SEQ ID NO: 40234 - DNA, 902 bp, Artificial Sequence
  chemically treated genomic DNA (Homo sapiens) CpG-island No: 40234
caaacccaaacacctcgaacaaactaaaaaaaataaaaaatacaaaaccgtaaacactactcgcttccaaaaactccgcaaaaccgtaataccgcgaacttaaccgcgaatacgactaacgaaacacctctcccgcaccccatccccgaacaaacgccaatcccgccgaaatcccaaaaataaatacaccaaaaaacgccaaaaaaacaaaccgaaacgaaccgaaacccacccaacgcgaaaacaacccgattctacctacacccgcgccctctacttcgaccgaaacgccctctctccgcaacgcccccaataatcgcgaccgaaaccgaaaaacgaaaccgcccgaaaatccccgccgcactcaccgctcttacccacgcgaccgacgcccaacaccgccaatttaatatccttaaacaataaataatccgaaaaaaactcgaaaataaatacgaacaaaaaatacccgaacatactaaacgaccgcataaaacgcgtcccgaaatccgacgcgcaatccgaaaaaactaaacctcgccgcacccgaaaccgactcgccaactaaaaatacgaaactaaaaatccgaaaccgcgacgactacctacaaaactatcaaaacccgcgacttttaaaaaacttaatacgcccgaaaacgcgacgaccgtcccaactcctcctcgtctccgccccttcccgaaacgaccgaaaaaaacgaaaacaaaaaccgcgaaactaactatcgccgaaactatacgcttcgccgaactactaactactcgcgactccaaacgctctacgacaaaactacgactccgaaactcaaaccctaaaaatacgaccaccgtccaaaacgcgcgaataacctctaatcaaacattctacgaatctcctcgccccg

SEQ ID NO: 40235 - DNA, 902 bp, Artificial Sequence
  chemically treated genomic DNA (Homo sapiens) CpG-island No: 40235
taaatttaggtatttcggataaattggggggagtgaagggtgtagaatcgtgggtattgttcgtttttagaggtttcgtaaagtcgtggtgtcgcgggtttggtcgcgagtacgattggcgggatatttttttcgtattttattttcgaataggcgttaatttcgtcgagattttaggagtagatgtattaggaaacgttagggaagtaggtcgggacggatcgggatttatttagcgcgaaagtagttcgattttatttgtattcgcgttttttgtttcggtcgaggcgtttttttttcgtagcgtttttagtggtcgcggtcggagtcggggagcgaagtcgttcgggggttttcgtcgtatttatcgtttttgtttacgcggtcggcgtttagtatcgttagtttgatgtttttgggtagtaggtagttcgaggaggattcggggatgggtgcgagtagaaagtgttcggatatgttgagcggtcgtatggagcgcgtttcggggttcggcgcgtaattcgagagggttgggtttcgtcgtattcggagtcggttcgttagttgggagtgcgggattagaggttcgggatcgcggcggttgtttgtagaattgttaaggttcgcggtttttaaagggtttggtgcgttcgggagcgcggcggtcgttttagttttttttcgttttcgttttttttcggagcggtcgggaggggcgggagtagaggtcgcggagttgattatcgtcgaggttgtgcgtttcgtcgggttgttagttgttcgcggttttaggcgttttgcggtaggattgcggtttcggggtttagattttggagatacggttatcgtttagagcgcgcgagtggtttttagttaggtattttgcgagttttttcgtttcg

SEQ ID NO: 40236 - DNA, 902 bp, Artificial Sequence
  chemically treated genomic DNA (Homo sapiens) CpG-island No: 40236
cgaaacgaaaaaactcgcaaaatacctaactaaaaaccactcgcgcgctctaaacgataaccgtatctccaaaatctaaaccccgaaaccgcaatcctaccgcaaaacgcctaaaaccgcgaacaactaacaacccgacgaaacgcacaacctcgacgataatcaactccgcgacctctactcccgcccctcccgaccgctccgaaaaaaaacgaaaacgaaaaaaaactaaaacgaccgccgcgctcccgaacgcaccaaaccctttaaaaaccgcgaaccttaacaattctacaaacaaccgccgcgatcccgaacctctaatcccgcactcccaactaacgaaccgactccgaatacgacgaaacccaaccctctcgaattacgcgccgaaccccgaaacgcgctccatacgaccgctcaacatatccgaacactttctactcgcacccatccccgaatcctcctcgaactacctactacccaaaaacatcaaactaacgatactaaacgccgaccgcgtaaacaaaaacgataaatacgacgaaaacccccgaacgacttcgctccccgactccgaccgcgaccactaaaaacgctacgaaaaaaaaacgcctcgaccgaaacaaaaaacgcgaatacaaataaaatcgaactactttcgcgctaaataaatcccgatccgtcccgacctacttccctaacgtttcctaatacatctactcctaaaatctcgacgaaattaacgcctattcgaaaataaaatacgaaaaaaatatcccgccaatcgtactcgcgaccaaacccgcgacaccacgactttacgaaacctctaaaaacgaacaatacccacgattctacacccttcactccccccaatttatccgaaatacctaaattta

SEQ ID NO: 40237 - DNA, 571 bp, Artificial Sequence
  chemically treated genomic DNA (Homo sapiens) CpG-island No: 40237
gcgggttcggtttacgtgcgtttttttttttttttttgtttgttttttattttttttttcggcggcggcggtagttttacgcgggattttcgggttgggcgggttggggcggtggcgcggggttggggcggcggcggcggtggggggggcgcgtggtagcggcggcgcgcgaggtttcgggtgcggtcggggagaaggggcgggtacgcggggatcggttggcgcgagagcggcggtgggggaggggcggcggcggttttacgcgttcgcgttgcgttagtcgtttacggcggtagcggcggttgtttcgcgatcgttaaggaatgcggcggtttcgtataattacggggttagaggttacggtttcggttttcgttttttcgttttgttgagggattgagataggatcgacggcggggcgggagggcgagacgcggtttttttttcggcgttcgggtgcgtgcgtgtttgtcgtgggtgtgtgtgagtgtgtgtgaagagtgaggagggggagtgtggggttttttttttttgaataaaaataaatcgaaagggcgtttgggagtcgtag

SEQ ID NO: 40238 - DNA, 571 bp, Artificial Sequence
  chemically treated genomic DNA (Homo sapiens) CpG-island No: 40238
ctacgactcccaaacgccctttcgatttatttttattcaaaaaaaaaaaaccccacactccccctcctcactcttcacacacactcacacacacccacgacaaacacgcacgcacccgaacgccgaaaaaaaaaccgcgtctcgccctcccgccccgccgtcgatcctatctcaatccctcaacaaaacgaaaaaacgaaaaccgaaaccgtaacctctaaccccgtaattatacgaaaccgccgcattccttaacgatcgcgaaacaaccgccgctaccgccgtaaacgactaacgcaacgcgaacgcgtaaaaccgccgccgcccctcccccaccgccgctctcgcgccaaccgatccccgcgtacccgccccttctccccgaccgcacccgaaacctcgcgcgccgccgctaccacgcgccccccccaccgccgccgccgccccaaccccgcgccaccgccccaacccgcccaacccgaaaatcccgcgtaaaactaccgccgccgccgaaaaaaaaaataaaaaacaaacaaaaaaaaaaaaaaaaacgcacgtaaaccgaacccgc

SEQ ID NO: 40239 - DNA, 571 bp, Artificial Sequence
  chemically treated genomic DNA (Homo sapiens) CpG-island No: 40239
ttacgatttttaggcgttttttcggtttgtttttgtttaaaaaaaaaaaattttatattttttttttttattttttatatatatttatatatatttacggtagatacgtacgtattcgggcgtcgaagggaaagtcgcgtttcgttttttcgtttcgtcgtcggttttgttttagttttttagtagagcgggaaagcggaggtcggagtcgtgatttttgatttcgtggttatgcggagtcgtcgtattttttagcgatcgcggggtagtcgtcgttgtcgtcgtgggcgattgacgtagcgcgggcgcgtggagtcgtcgtcgttttttttttatcgtcgttttcgcgttagtcggttttcgcgtgttcgtttttttttttcggtcgtattcgagatttcgcgcgtcgtcgttgttacgcgttttttttatcgtcgtcgtcgttttagtttcgcgttatcgttttagttcgtttagttcggaggtttcgcgtggagttgtcgtcgtcgtcggggagaaggatgaaggataaatagaagaagaagaaggagcgtacgtgggtcgagttcgt

SEQ ID NO: 40240 - DNA, 571 bp, Artificial Sequence
  chemically treated genomic DNA (Homo sapiens) CpG-island No: 40240
acgaactcgacccacgtacgctccttcttcttcttctatttatccttcatccttctccccgacgacgacgacaactccacgcgaaacctccgaactaaacgaactaaaacgataacgcgaaactaaaacgacgacgacgataaaaaaaacgcgtaacaacgacgacgcgcgaaatctcgaatacgaccgaaaaaaaaaaacgaacacgcgaaaaccgactaacgcgaaaacgacgataaaaaaaaaacgacgacgactccacgcgcccgcgctacgtcaatcgcccacgacgacaacgacgactaccccgcgatcgctaaaaaatacgacgactccgcataaccacgaaatcaaaaatcacgactccgacctccgctttcccgctctactaaaaaactaaaacaaaaccgacgacgaaacgaaaaaacgaaacgcgactttcccttcgacgcccgaatacgtacgtatctaccgtaaatatatataaatatatataaaaaataaaaaaaaaaaatataaaattttttttttttaaacaaaaacaaaccgaaaaaacgcctaaaaatcgtaa

SEQ ID NO: 40241 - DNA, 760 bp, Artificial Sequence
  chemically treated genomic DNA (Homo sapiens) CpG-island No: 40241
cgttttcgcgttttggagttcgcggtgggcgagagcgagtcggcggtcgcggtagttatggcgttcgtttttgtcggggagtcggtatcgttcgcgttcgcgtttttagaggattattcggacgaggagatggggtttattatcgatattaagagtttttttaagtcgggcgagaagacgtatacgtagcgttgtcgttttttcgtgggaaatttgtttatcgatattacggaggaggattttaagaggtttttcgaacgttatggcgagtttagcgaagtttttattaatcgggatcgtggtttcggttttattcgtttggtgagtgttaggcgttcgcgcgagggaataaaaggattgtcggggtggtcgcggggtcgtggggttgaggttagtttcgttttaggacgttgttttaatttgtggtaatcgtggcgtcgttcggttttatcgatttttttgtgcggggttggtcgtttttttagttcggcgtttttggtttcgagtttacggtttcgggattttttgcgtttatagtggtcgtcgttttttgtcgtgcgtcgatcgtgttttgcggtggttgtaggtttgttgttttgcgttggatcgggtatggtgtattttgtttaggtagcgagcgttttcgggtttttcgttgtttcgggtatcgaaagggttcggggataggggcgggtagcgttttggggtgagaattttttaaggtaaaaatcgtgttataaaaaacgaattggatgtatat

SEQ ID NO: 40242 - DNA, 760 bp, Artificial Sequence
  chemically treated genomic DNA (Homo sapiens) CpG-island No: 40242
atatacatccaattcgttttttataacacgatttttaccttaaaaaattctcaccccaaaacgctacccgcccctatccccgaaccctttcgatacccgaaacaacgaaaaacccgaaaacgctcgctacctaaacaaaatacaccatacccgatccaacgcaaaacaacaaacctacaaccaccgcaaaacacgatcgacgcacgacaaaaaacgacgaccactataaacgcaaaaaatcccgaaaccgtaaactcgaaaccaaaaacgccgaactaaaaaaacgaccaaccccgcacaaaaaaatcgataaaaccgaacgacgccacgattaccacaaattaaaacaacgtcctaaaacgaaactaacctcaaccccacgaccccgcgaccaccccgacaatccttttattccctcgcgcgaacgcctaacactcaccaaacgaataaaaccgaaaccacgatcccgattaataaaaacttcgctaaactcgccataacgttcgaaaaacctcttaaaatcctcctccgtaatatcgataaacaaatttcccacgaaaaaacgacaacgctacgtatacgtcttctcgcccgacttaaaaaaactcttaatatcgataataaaccccatctcctcgtccgaataatcctctaaaaacgcgaacgcgaacgataccgactccccgacaaaaacgaacgccataactaccgcgaccgccgactcgctctcgcccaccgcgaactccaaaacgcgaaaacg

SEQ ID NO: 40243 - DNA, 760 bp, Artificial Sequence
  chemically treated genomic DNA (Homo sapiens) CpG-island No: 40243
atgtatatttaattcgttttttatggtacgatttttgttttgaagaatttttattttaaaacgttgttcgtttttgttttcggattttttcggtattcggggtaacggggaattcgggagcgttcgttatttggatagggtgtattatgttcgatttagcgtagggtagtaggtttgtagttatcgtaaagtacgatcggcgtacggtagaaaacggcggttattgtgagcgtaggaaatttcgggatcgtgaattcgaaattaaaggcgtcgagttggggaagcggttaatttcgtatagaggaatcgatgaggtcgagcggcgttacggttgttataggttgagatagcgttttaggacgaggttggttttagttttacgatttcgcggttatttcgatagtttttttgttttttcgcgcgggcgtttgatatttattaagcggatgaagtcgaagttacggtttcggttgatgaagatttcgttgggttcgttatagcgttcgaagagttttttgaagttttttttcgtgatgtcggtgggtagattttttacgaagaggcggtagcgttgcgtgtacgttttttcgttcggtttgaggaaatttttgatgtcgatagtgaattttattttttcgttcgggtggttttttggaggcgcgggcgcgggcggtgtcggtttttcggtaagagcgagcgttatggttgtcgcggtcgtcggttcgttttcgtttatcgcggattttagggcgcgaaggcg

SEQ ID NO: 40244 - DNA, 760 bp, Artificial Sequence
  chemically treated genomic DNA (Homo sapiens) CpG-island No: 40244
cgccttcgcgccctaaaatccgcgataaacgaaaacgaaccgacgaccgcgacaaccataacgctcgctcttaccgaaaaaccgacaccgcccgcgcccgcgcctccaaaaaaccacccgaacgaaaaaataaaattcactatcgacatcaaaaatttcctcaaaccgaacgaaaaaacgtacacgcaacgctaccgcctcttcgtaaaaaatctacccaccgacatcacgaaaaaaaacttcaaaaaactcttcgaacgctataacgaacccaacgaaatcttcatcaaccgaaaccgtaacttcgacttcatccgcttaataaatatcaaacgcccgcgcgaaaaaacaaaaaaactatcgaaataaccgcgaaatcgtaaaactaaaaccaacctcgtcctaaaacgctatctcaacctataacaaccgtaacgccgctcgacctcatcgattcctctatacgaaattaaccgcttccccaactcgacgcctttaatttcgaattcacgatcccgaaatttcctacgctcacaataaccgccgttttctaccgtacgccgatcgtactttacgataactacaaacctactaccctacgctaaatcgaacataatacaccctatccaaataacgaacgctcccgaattccccgttaccccgaataccgaaaaaatccgaaaacaaaaacgaacaacgttttaaaataaaaattcttcaaaacaaaaatcgtaccataaaaaacgaattaaatatacat

SEQ ID NO: 40245 - DNA, 575 bp, Artificial Sequence
  chemically treated genomic DNA (Homo sapiens) CpG-island No: 40245
cgttatgggatttcgcgttttcgtgttgggcggcggatgtttttgcggttttttcggcgggggaaggtgtgcgttttcgtcgttttattgtgtgtatacgcgggagtattttggttttcgtttttcgttgttttcgcgtttttttattttttagttgatggtttaggttcggttggttagggagttcgggttatttcggggcggttgtaaggcgtagacggagagtcgagtcgggcgtttatttcgcgttttggttcgggtaaatttggaagaattgcgatcgtagtttgtttagcgttatagtttgagtggcgttttttttattttcgtttttgcgtcggtaggggcggtggagagacgcggagggtttttttagttttttttttttttattcgtttttcgggcgatagagcgttcggcgttcgggtcgggggcgggtaaggttgggagggattttcgtcggggatttggtttttggacgtcggcgttttaaggttggtttggggattttacgggttgtttgttttagatgtggggcgggttttttcgttagggttttttagtgtttttttagt

SEQ ID NO: 40246 - DNA, 575 bp, Artificial Sequence
  chemically treated genomic DNA (Homo sapiens) CpG-island No: 40246
actaaaaaaacactaaaaaaccctaacgaaaaaacccgccccacatctaaaacaaacaacccgtaaaatccccaaaccaaccttaaaacgccgacgtccaaaaaccaaatccccgacgaaaatccctcccaaccttacccgcccccgacccgaacgccgaacgctctatcgcccgaaaaacgaataaaaaaaaaaaaaactaaaaaaaccctccgcgtctctccaccgcccctaccgacgcaaaaacgaaaataaaaaaaacgccactcaaactataacgctaaacaaactacgatcgcaattcttccaaatttacccgaaccaaaacgcgaaataaacgcccgactcgactctccgtctacgccttacaaccgccccgaaataacccgaactccctaaccaaccgaacctaaaccatcaactaaaaaataaaaaaacgcgaaaacaacgaaaaacgaaaaccaaaatactcccgcgtatacacacaataaaacgacgaaaacgcacaccttcccccgccgaaaaaaccgcaaaaacatccgccgcccaacacgaaaacgcgaaatcccataacg

SEQ ID NO: 40247 - DNA, 575 bp, Artificial Sequence
  chemically treated genomic DNA (Homo sapiens) CpG-island No: 40247
attggggaagtattgaggaattttaacgggaaagttcgttttatatttgaaataggtagttcgtgaagtttttaaattagttttgaaacgtcggcgtttagaggttaggttttcggcgagggttttttttagttttgttcgttttcggttcgagcgtcgggcgttttgtcgttcgaaggacggataggggagagaggggttgggggagtttttcgcgtttttttatcgtttttgtcggcgtaagggcgggagtggagaaggcgttatttagattgtggcgttgggtaaattgcggtcgtagtttttttaagtttgttcgaattagaacgcggagtgagcgttcggttcggtttttcgtttgcgttttgtagtcgtttcggagtgattcgggttttttggttagtcgggtttgagttattaattaaggggtagaagggcgcgagagtagcgggaggcgggagttagggtgttttcgcgtgtgtatataatgaggcggcggagacgtatattttttttcgtcgaagaagtcgtaggagtattcgtcgtttaatacggagacgcggagttttatagcg

SEQ ID NO: 40248 - DNA, 575 bp, Artificial Sequence
  chemically treated genomic DNA (Homo sapiens) CpG-island No: 40248
cgctataaaactccgcgtctccgtattaaacgacgaatactcctacgacttcttcgacgaaaaaaaatatacgtctccgccgcctcattatatacacacgcgaaaacaccctaactcccgcctcccgctactctcgcgcccttctaccccttaattaataactcaaacccgactaaccaaaaaacccgaatcactccgaaacgactacaaaacgcaaacgaaaaaccgaaccgaacgctcactccgcgttctaattcgaacaaacttaaaaaaactacgaccgcaatttacccaacgccacaatctaaataacgccttctccactcccgcccttacgccgacaaaaacgataaaaaaacgcgaaaaactcccccaacccctctctcccctatccgtccttcgaacgacaaaacgcccgacgctcgaaccgaaaacgaacaaaactaaaaaaaaccctcgccgaaaacctaacctctaaacgccgacgtttcaaaactaatttaaaaacttcacgaactacctatttcaaatataaaacgaactttcccgttaaaattcctcaatacttccccaat

SEQ ID NO: 40249 - DNA, 822 bp, Artificial Sequence
  chemically treated genomic DNA (Homo sapiens) CpG-island No: 40249
gggggcggggttttggacgggggcggagttacggcgagagtcgcggtgagggcggggttcgggtgggcggtgttttgagcggggtttttagtgggcggggttttggggtggcggtcgttgtcgggttacgggagagcgcggagttttgcgttgggaggtgtacggtgtgtacgttggattggatttttatgtaatttcgcgttttgcgttttaattaggattgtttcgcgcgtttttgagtttcgggtttcggttcggatttgtagttttttaggtggttgggaaggtaggtgcgtcgttgttttcggcgcgcggcgtttcgcgaggtttttagttttcgttttggtggattttcgttgggtgggagtcgggagtggaggcggtcgttttagggagggaggagcgtaggcgggggttgtttacgggcggagtattgcgcggcgaagggaattttcgaaggggttgatcgggtttcggggtcgtgataggcggcgaggcggtgggaggggagcgtgtgaatttacgtcgggttttcgcgggcgacgcgagcgacgcgatttggatttttattcgggatattgtaaatagatttgtttgtgaggtttacgattgggagtttgttattttgtttaagttcgattcggtttcggcgttcgttcgcgttttgcggaggttttttgagttagcgcgcggttgtaggggtttcggggtcgtatttcggattagcgttagcggcgggagagcgttgtttgtgagcggtttagggtatattttttttgtgggaaagagttttttagagtttagtaggaattattagtatat

SEQ ID NO: 40250 - DNA, 822 bp, Artificial Sequence
  chemically treated genomic DNA (Homo sapiens) CpG-island No: 40250
atatactaataattcctactaaactctaaaaaactctttcccacaaaaaaaatataccctaaaccgctcacaaacaacgctctcccgccgctaacgctaatccgaaatacgaccccgaaacccctacaaccgcgcgctaactcaaaaaacctccgcaaaacgcgaacgaacgccgaaaccgaatcgaacttaaacaaaataacaaactcccaatcgtaaacctcacaaacaaatctatttacaatatcccgaataaaaatccaaatcgcgtcgctcgcgtcgcccgcgaaaacccgacgtaaattcacacgctcccctcccaccgcctcgccgcctatcacgaccccgaaacccgatcaaccccttcgaaaattcccttcgccgcgcaatactccgcccgtaaacaacccccgcctacgctcctccctccctaaaacgaccgcctccactcccgactcccacccaacgaaaatccaccaaaacgaaaactaaaaacctcgcgaaacgccgcgcgccgaaaacaacgacgcacctaccttcccaaccacctaaaaaactacaaatccgaaccgaaacccgaaactcaaaaacgcgcgaaacaatcctaattaaaacgcaaaacgcgaaattacataaaaatccaatccaacgtacacaccgtacacctcccaacgcaaaactccgcgctctcccgtaacccgacaacgaccgccaccccaaaaccccgcccactaaaaaccccgctcaaaacaccgcccacccgaaccccgccctcaccgcgactctcgccgtaactccgcccccgtccaaaaccccgccccc

SEQ ID NO: 40251 - DNA, 822 bp, Artificial Sequence
  chemically treated genomic DNA (Homo sapiens) CpG-island No: 40251
atatattaataatttttgttgaattttaaggaatttttttttatagaaggaatatattttgggtcgtttatagataacgttttttcgtcgttggcgttggttcgggatgcggtttcgagatttttgtagtcgcgcgttggtttaggggattttcgtaggacgcgggcgggcgtcggggtcgggtcgggtttgggtagagtgataggtttttagtcgtgagttttataagtagatttatttataatatttcggataggagtttaggtcgcgtcgttcgcgtcgttcgcggggattcggcgtgaatttatacgttttttttttatcgtttcgtcgtttgttacggtttcgagattcggttagttttttcgggggtttttttcgtcgcgtagtatttcgttcgtgagtagttttcgtttgcgtttttttttttttagggcggtcgtttttattttcggtttttatttagcggggatttattagggcgagggttgaagatttcgcgggacgtcgcgcgtcggggatagcgacgtatttatttttttagttatttgggaggttgtaggttcgggtcggagttcgaggtttaggggcgcgcggagtagttttggttaaggcgtagggcgcggggttgtatgggggtttagtttagcgtgtatatcgtgtattttttagcgtagggtttcgcgttttttcgtagttcggtaacggtcgttattttagagtttcgtttattaggagtttcgtttagggtatcgtttattcgggtttcgtttttatcgcggttttcgtcgtggtttcgttttcgtttagagtttcgttttt

SEQ ID NO: 40252 - DNA, 822 bp, Artificial Sequence
  chemically treated genomic DNA (Homo sapiens) CpG-island No: 40252
aaaaacgaaactctaaacgaaaacgaaaccacgacgaaaaccgcgataaaaacgaaacccgaataaacgataccctaaacgaaactcctaataaacgaaactctaaaataacgaccgttaccgaactacgaaaaaacgcgaaaccctacgctaaaaaatacacgatatacacgctaaactaaacccccatacaaccccgcgccctacgccttaaccaaaactactccgcgcgcccctaaacctcgaactccgacccgaacctacaacctcccaaataactaaaaaaataaatacgtcgctatccccgacgcgcgacgtcccgcgaaatcttcaaccctcgccctaataaatccccgctaaataaaaaccgaaaataaaaacgaccgccctaaaaaaaaaaaaacgcaaacgaaaactactcacgaacgaaatactacgcgacgaaaaaaacccccgaaaaaactaaccgaatctcgaaaccgtaacaaacgacgaaacgataaaaaaaaaacgtataaattcacgccgaatccccgcgaacgacgcgaacgacgcgacctaaactcctatccgaaatattataaataaatctacttataaaactcacgactaaaaacctatcactctacccaaacccgacccgaccccgacgcccgcccgcgtcctacgaaaatcccctaaaccaacgcgcgactacaaaaatctcgaaaccgcatcccgaaccaacgccaacgacgaaaaaacgttatctataaacgacccaaaatatattccttctataaaaaaaaattccttaaaattcaacaaaaattattaatatat

SEQ ID NO: 40253 - DNA, 813 bp, Artificial Sequence
  chemically treated genomic DNA (Homo sapiens) CpG-island No: 40253
gtcgagcgaggtttcgtgcgaggatagttttttaatcgtattttttagagggagcgttgggattcgcggaggagattagttttcggttataaataattttttattttttttttttcgttcgcgttcgttcgcgtcggggcggcgcgtcggggcggtttttcgaggtttaggaatttttttcggcgttcgcgaggtttcgagttttttttcggagggcggttgcgggtttgttttttttttttaattaggtgtttgtttattttatttaattttttttattcgtttacgttacggttattttataggggcggttgacgttagttttttttttttttttttcgatttttattatttttaatagttaaggagaggtcggcggttttgacgcgtaggtttatcgtcgcggtcgtttcgcgcgcgcggacgcggttttcgtttttatttcgcggttttttcgtagttcggtttcgttttttttcgaagttcgttttcgggtcggttcgttcgttcgttcgcgcgtattcgacgtttcgtttttgcgcgtgtttaataattgttttcggagtcggtttataagtttttttcgtttttgagttgtttaaatatgttaatgaaaggatagggtttgattagtagaacggcgaggcggtgtattacgtggttcggggacgtgttaggggcggagttttcgtagtttttgttcgagttaaaatcggagtgtgagagagaaaagcgttttagtagcgagaggggttgagaaagtggtgatatcgtcggggtgcggagggagtttttgaaattttttttaatagt

SEQ ID NO: 40254 - DNA, 813 bp, Artificial Sequence
  chemically treated genomic DNA (Homo sapiens) CpG-island No: 40254
actattaaaaaaaatttcaaaaactccctccgcaccccgacgatatcaccactttctcaacccctctcgctactaaaacgcttttctctctcacactccgattttaactcgaacaaaaactacgaaaactccgcccctaacacgtccccgaaccacgtaatacaccgcctcgccgttctactaatcaaaccctatcctttcattaacatatttaaacaactcaaaaacgaaaaaaacttataaaccgactccgaaaacaattattaaacacgcgcaaaaacgaaacgtcgaatacgcgcgaacgaacgaacgaaccgacccgaaaacgaacttcgaaaaaaaacgaaaccgaactacgaaaaaaccgcgaaataaaaacgaaaaccgcgtccgcgcgcgcgaaacgaccgcgacgataaacctacgcgtcaaaaccgccgacctctccttaactattaaaaataataaaaatcgaaaaaaaaaaaaaaaaaactaacgtcaaccgcccctataaaataaccgtaacgtaaacgaataaaaaaaattaaataaaataaacaaacacctaattaaaaaaaaaaaacaaacccgcaaccgccctccgaaaaaaaactcgaaacctcgcgaacgccgaaaaaaattcctaaacctcgaaaaaccgccccgacgcgccgccccgacgcgaacgaacgcgaacgaaaaaaaaaaaataaaaaattatttataaccgaaaactaatctcctccgcgaatcccaacgctccctctaaaaaatacgattaaaaaactatcctcgcacgaaacctcgctcgac

SEQ ID NO: 40255 - DNA, 813 bp, Artificial Sequence
  chemically treated genomic DNA (Homo sapiens) CpG-island No: 40255
gttgttgggagaagttttagggatttttttcgtatttcggcggtgttattatttttttagtttttttcgttattgaagcgttttttttttttatatttcggttttaattcgggtaggggttgcggaggtttcgtttttgatacgttttcgagttacgtgatatatcgtttcgtcgttttattggttaggttttatttttttattagtatatttaaatagtttaggggcgggggaagtttgtaggtcggtttcggggatagttattgagtacgcgtagaggcggggcgtcgggtgcgcgcgagcgggcgggcgggtcgattcggaggcgggtttcgggaaggggcggggtcggattgcggaaggatcgcgaggtgggggcgggggtcgcgttcgcgcgcgcggggcggtcgcggcggtgagtttgcgcgttagggtcgtcggtttttttttggttgttggaggtgataggggtcgaggggagggaaaaaggggttggcgttagtcgtttttgtgaggtggtcgtagcgtggacgagtaagaagggttgagtaaagtggataaatatttggttaggagaagagggtaggttcgtagtcgtttttcggaggaggattcggggtttcgcgggcgtcggaggaggtttttgggtttcggagggtcgtttcggcgcgtcgtttcggcgcgagcgggcgcgggcgggggaggggaagtgagaggttgtttatgatcggggattaatttttttcgcgagttttagcgttttttttggggagtgcggttgaggggttgttttcgtacggagtttcgttcggt

SEQ ID NO: 40256 - DNA, 813 bp, Artificial Sequence
  chemically treated genomic DNA (Homo sapiens) CpG-island No: 40256
accgaacgaaactccgtacgaaaacaacccctcaaccgcactccccaaaaaaaacgctaaaactcgcgaaaaaaattaatccccgatcataaacaacctctcacttcccctcccccgcccgcgcccgctcgcgccgaaacgacgcgccgaaacgaccctccgaaacccaaaaacctcctccgacgcccgcgaaaccccgaatcctcctccgaaaaacgactacgaacctaccctcttctcctaaccaaatatttatccactttactcaacccttcttactcgtccacgctacgaccacctcacaaaaacgactaacgccaacccctttttccctcccctcgacccctatcacctccaacaaccaaaaaaaaaccgacgaccctaacgcgcaaactcaccgccgcgaccgccccgcgcgcgcgaacgcgacccccgcccccacctcgcgatccttccgcaatccgaccccgccccttcccgaaacccgcctccgaatcgacccgcccgcccgctcgcgcgcacccgacgccccgcctctacgcgtactcaataactatccccgaaaccgacctacaaacttcccccgcccctaaactatttaaatatactaataaaaaaataaaacctaaccaataaaacgacgaaacgatatatcacgtaactcgaaaacgtatcaaaaacgaaacctccgcaacccctacccgaattaaaaccgaaatataaaaaaaaaaaacgcttcaataacgaaaaaaactaaaaaaataataacaccgccgaaatacgaaaaaaatccctaaaacttctcccaacaac

SEQ ID NO: 40257 - DNA, 629 bp, Artificial Sequence
  chemically treated genomic DNA (Homo sapiens) CpG-island No: 40257
gcggcgcgcggggagggggtcgggggcggtggcggcggcgttggggggcggggaggaggtaggaggaggagtagtagcgttcgtcgggggatgtagtagcggtagcggcggcggcggcggcggtagcggtagcggcggcgcggagttttttgcgtttagcggttcggtcgggttgcggtagaggcggcggcggcgtttcgtttcgggtgaggttgtcggggtcgtgcgcgttggtgagtggggcgtggggggtaggtgggtggttgggggacgcggggttcgggcgggggttcgcggcggtcggagtttttttcggcgtgagttcggtcgcgagcgtcgtttaggtgagtcggggttggttcggatcgttcggttttagttttagcgttgtttgcggaggtgggttcgggcgggcgggagggaggtttcggcgtcggtcgttcgtagagggatgatttgtttgatttcgttggttggcgggcgggcgaggatttttcgtcgcgtttttgattcgcggatacggtatatcgagtataggcggtttcgggtaggggagcgcgtttgggtcggttattcgtaggggtatggttttgttgatttttagggtttagatttaagggatcggtaga

SEQ ID NO: 40258 - DNA, 629 bp, Artificial Sequence
  chemically treated genomic DNA (Homo sapiens) CpG-island No: 40258
tctaccgatcccttaaatctaaaccctaaaaatcaacaaaaccatacccctacgaataaccgacccaaacgcgctcccctacccgaaaccgcctatactcgatataccgtatccgcgaatcaaaaacgcgacgaaaaatcctcgcccgcccgccaaccaacgaaatcaaacaaatcatccctctacgaacgaccgacgccgaaacctccctcccgcccgcccgaacccacctccgcaaacaacgctaaaactaaaaccgaacgatccgaaccaaccccgactcacctaaacgacgctcgcgaccgaactcacgccgaaaaaaactccgaccgccgcgaacccccgcccgaaccccgcgtcccccaaccacccacctaccccccacgccccactcaccaacgcgcacgaccccgacaacctcacccgaaacgaaacgccgccgccgcctctaccgcaacccgaccgaaccgctaaacgcaaaaaactccgcgccgccgctaccgctaccgccgccgccgccgccgctaccgctactacatcccccgacgaacgctactactcctcctcctacctcctccccgccccccaacgccgccgccaccgcccccgaccccctccccgcgcgccgc

SEQ ID NO: 40259 - DNA, 629 bp, Artificial Sequence
  chemically treated genomic DNA (Homo sapiens) CpG-island No: 40259
tttatcggttttttgggtttaaattttaagggttaataaggttatgtttttgcggatggtcggtttaggcgcgtttttttattcggggtcgtttgtgttcggtgtgtcgtgttcgcgggttaggggcgcggcgggaagttttcgttcgttcgttagttagcggggttaaataggttatttttttgcggacggtcggcgtcggagtttttttttcgttcgttcggatttattttcgtaagtagcgttggggttggagtcgggcggttcggattagtttcggtttatttgggcggcgttcgcggtcgggtttacgtcggggaaggtttcggtcgtcgcgagttttcgttcgagtttcgcgttttttagttatttatttgttttttacgttttatttattagcgcgtacggtttcggtaattttattcggagcggggcgtcgtcgtcgtttttgtcgtagttcggtcgggtcgttgggcgtaggggatttcgcgtcgtcgttgtcgttgtcgtcgtcgtcgtcgtcgttgtcgttgttgtatttttcggcgagcgttgttgtttttttttttgtttttttttcgttttttagcgtcgtcgttatcgttttcggtttttttttcgcgcgtcgt

SEQ ID NO: 40260 - DNA, 629 bp, Artificial Sequence
  chemically treated genomic DNA (Homo sapiens) CpG-island No: 40260
acgacgcgcgaaaaaaaaaccgaaaacgataacgacgacgctaaaaaacgaaaaaaaaacaaaaaaaaaaacaacaacgctcgccgaaaaatacaacaacgacaacgacgacgacgacgacgacaacgacaacgacgacgcgaaatcccctacgcccaacgacccgaccgaactacgacaaaaacgacgacgacgccccgctccgaataaaattaccgaaaccgtacgcgctaataaataaaacgtaaaaaacaaataaataactaaaaaacgcgaaactcgaacgaaaactcgcgacgaccgaaaccttccccgacgtaaacccgaccgcgaacgccgcccaaataaaccgaaactaatccgaaccgcccgactccaaccccaacgctacttacgaaaataaatccgaacgaacgaaaaaaaaactccgacgccgaccgtccgcaaaaaaataacctatttaaccccgctaactaacgaacgaacgaaaacttcccgccgcgcccctaacccgcgaacacgacacaccgaacacaaacgaccccgaataaaaaaacgcgcctaaaccgaccatccgcaaaaacataaccttattaacccttaaaatttaaacccaaaaaaccgataaa

SEQ ID NO: 40261 - DNA, 1020 bp, Artificial Sequence
  chemically treated genomic DNA (Homo sapiens) CpG-island No: 40261
tgcggtcgcggcggtcgcggggttgttttgcgtcgcgggcggttttatgaggcggtttagttgggttcggcgcgcgtggttttgggttttgcgaggtggtagtcggggttattcgggggtttgttgtttcgtatattttagttttgttagttttttcggcgttgcgttttagtcgcgtcgtttttagtacggttcgcgttcgttttattatcggttcgggtttttagattttatagttttcggcggtcggagcggaggcggggtcggggcggggttgcggagtcggggcgacgggtttgttttcgtcgtttttcgaggaggtttttgtttttaggtatcgttttcgttacgcgttcgttttggaatcgcggtgacgaggagtcgtcgaagtttcggttatagttttaaatatttattcgtttttcgttttcgcgttttgataattcggtttacgcggtgttttcggcgttattagagttgattgttgggcgcgagttttgttgtttttcgtcgcgtgttaggtattttcgcgagtcgtagttttttcggttgtgaagtggacgtgggtatgtagagtttttttggttggcggtgagggacgaaggagttcgcggtcgtgttttagtcgggtgtcggggacgcggaggttttttacgtattgttttaaggggattttcgagatggtgggcgggcggagtggagagggtcggggcgagaggggtaggagttgggggagttttgaattgtttttatcgcggagcgcgggggtttgaattacggtttagggcgttttcgttagtttgattttatttagaaggggtttattatgggaagaaattattgcgtcgacgtagcgcgaatagggcgttttgtagtgtttacggagtaacgagttattttgtttcgcggtttgcgggggcgaacgttttggattgtgcgttgagttaggcgttagtttttcgttttttattatagacggttaattaaatgtagagtaattaatatgtaacggagtgaaat

SEQ ID NO: 40262 - DNA, 1020 bp, Artificial Sequence
  chemically treated genomic DNA (Homo sapiens) CpG-island No: 40262
atttcactccgttacatattaattactctacatttaattaaccgtctataataaaaaacgaaaaactaacgcctaactcaacgcacaatccaaaacgttcgcccccgcaaaccgcgaaacaaaataactcgttactccgtaaacactacaaaacgccctattcgcgctacgtcgacgcaataatttcttcccataataaaccccttctaaataaaatcaaactaacgaaaacgccctaaaccgtaattcaaacccccgcgctccgcgataaaaacaattcaaaactcccccaactcctacccctctcgccccgaccctctccactccgcccgcccaccatctcgaaaatccccttaaaacaatacgtaaaaaacctccgcgtccccgacacccgactaaaacacgaccgcgaactccttcgtccctcaccgccaaccaaaaaaactctacatacccacgtccacttcacaaccgaaaaaactacgactcgcgaaaatacctaacacgcgacgaaaaacaacaaaactcgcgcccaacaatcaactctaataacgccgaaaacaccgcgtaaaccgaattatcaaaacgcgaaaacgaaaaacgaataaatatttaaaactataaccgaaacttcgacgactcctcgtcaccgcgattccaaaacgaacgcgtaacgaaaacgatacctaaaaacaaaaacctcctcgaaaaacgacgaaaacaaacccgtcgccccgactccgcaaccccgccccgaccccgcctccgctccgaccgccgaaaactataaaatctaaaaacccgaaccgataataaaacgaacgcgaaccgtactaaaaacgacgcgactaaaacgcaacgccgaaaaaactaacaaaactaaaatatacgaaacaacaaacccccgaataaccccgactaccacctcgcaaaacccaaaaccacgcgcgccgaacccaactaaaccgcctcataaaaccgcccgcgacgcaaaacaaccccgcgaccgccgcgaccgca

SEQ ID NO: 40263 - DNA, 1020 bp, Artificial Sequence
  chemically treated genomic DNA (Homo sapiens) CpG-island No: 40263
gttttatttcgttatatgttaattgttttatatttaattagtcgtttgtggtgagaggcgagaggttagcgtttagtttagcgtatagtttagggcgttcgttttcgtaggtcgcggggtagggtggttcgttatttcgtggatattgtaaggcgttttgttcgcgttgcgtcgacgtagtagtttttttttataataaattttttttagataaagttaggttggcgggagcgttttggatcgtagtttaggttttcgcgtttcgcggtggaaatagtttaggatttttttaatttttgtttttttcgtttcgattttttttatttcgttcgtttattatttcggaagtttttttgggataatgcgtaggggattttcgcgttttcgatattcgattgggatacggtcgcgggttttttcgttttttatcgttagttagggaggttttgtatgtttacgtttattttatagtcgaggaagttgcggttcgcggaggtgtttggtacgcggcgggaagtagtagagttcgcgtttagtagttagttttggtgacgtcgaggatatcgcgtgggtcgggttgttagggcgcgggggcgagaggcgggtaaatatttggggttgtaatcggggtttcggcgatttttcgttatcgcggttttagggcgggcgcgtggcgagggcggtgtttgggggtaggggttttttcggagggcggcggggatagattcgtcgtttcggtttcgtagtttcgtttcggtttcgttttcgtttcggtcgtcgaaggttataagatttaggaattcgagtcggtggtagggcgggcgcggatcgtgttgggagcggcgcggttggagcgtagcgtcgaagggattggtagggttgaagtgtgcgggatagtaagttttcgaatagtttcggttgttatttcgtaggatttaaggttacgcgcgtcgggtttagttgagtcgttttatgaagtcgttcgcggcgtagggtagtttcgcggtcgtcgcggtcgta

SEQ ID NO: 40264 - DNA, 1020 bp, Artificial Sequence
  chemically treated genomic DNA (Homo sapiens) CpG-island No: 40264
tacgaccgcgacgaccgcgaaactaccctacgccgcgaacgacttcataaaacgactcaactaaacccgacgcgcgtaaccttaaatcctacgaaataacaaccgaaactattcgaaaacttactatcccgcacacttcaaccctaccaatcccttcgacgctacgctccaaccgcgccgctcccaacacgatccgcgcccgccctaccaccgactcgaattcctaaatcttataaccttcgacgaccgaaacgaaaacgaaaccgaaacgaaactacgaaaccgaaacgacgaatctatccccgccgccctccgaaaaaacccctacccccaaacaccgccctcgccacgcgcccgccctaaaaccgcgataacgaaaaatcgccgaaaccccgattacaaccccaaatatttacccgcctctcgcccccgcgccctaacaacccgacccacgcgatatcctcgacgtcaccaaaactaactactaaacgcgaactctactacttcccgccgcgtaccaaacacctccgcgaaccgcaacttcctcgactataaaataaacgtaaacatacaaaacctccctaactaacgataaaaaacgaaaaaacccgcgaccgtatcccaatcgaatatcgaaaacgcgaaaatcccctacgcattatcccaaaaaaacttccgaaataataaacgaacgaaataaaaaaaatcgaaacgaaaaaaacaaaaattaaaaaaatcctaaactatttccaccgcgaaacgcgaaaacctaaactacgatccaaaacgctcccgccaacctaactttatctaaaaaaaatttattataaaaaaaaactactacgtcgacgcaacgcgaacaaaacgccttacaatatccacgaaataacgaaccaccctaccccgcgacctacgaaaacgaacgccctaaactatacgctaaactaaacgctaacctctcgcctctcaccacaaacgactaattaaatataaaacaattaacatataacgaaataaaac

SEQ ID NO: 40265 - DNA, 664 bp, Artificial Sequence
  chemically treated genomic DNA (Homo sapiens) CpG-island No: 40265
atcgcggagcgggaaaggattgcgggattttggggggtcgttcgtttatcggtttttttggaggttcgggcggtaggtagggaggggtttcgttttgcgtttggagggggcggttttggcggggtttgggcgttatagtggggcggggggcgtatgggttcgttttggggcgttagggcgggggcggcgatgacgcgtggttatcgtattcgagtcgcggatgacgcgcggtcgcgtttgggggatgcggcgggcggcggcgggggcgggcggagcgcgggcggcggggttaattgggggcgtttttcgtttgtattttaatgcgggacgtaggagcggtgcgcgggtcggggtttaggggtgcggcgggtttagggtgggttcggcggattcgcgggtttttttcgcgtagtttttggtttgtgttcgcggtcggagttagcggttcgtttgtgattcgaaggtcgcgagtgttttgttcgatttggtttttgacgttttcgttttgcgggtgcggttggaggagacgggggagatgtttcgagtggtaaattgtcgcggcgatatgatcgtgcgagagtttaaagaggagttggatttgatggtcggtattttttttaatttttagcggttttagtatttcgacgaaggtggtttttgtttt

SEQ ID NO: 40266 - DNA, 664 bp, Artificial Sequence
  chemically treated genomic DNA (Homo sapiens) CpG-island No: 40266
aaaacaaaaaccaccttcgtcgaaatactaaaaccgctaaaaattaaaaaaaataccgaccatcaaatccaactcctctttaaactctcgcacgatcatatcgccgcgacaatttaccactcgaaacatctcccccgtctcctccaaccgcacccgcaaaacgaaaacgtcaaaaaccaaatcgaacaaaacactcgcgaccttcgaatcacaaacgaaccgctaactccgaccgcgaacacaaaccaaaaactacgcgaaaaaaacccgcgaatccgccgaacccaccctaaacccgccgcacccctaaaccccgacccgcgcaccgctcctacgtcccgcattaaaatacaaacgaaaaacgcccccaattaaccccgccgcccgcgctccgcccgcccccgccgccgcccgccgcatcccccaaacgcgaccgcgcgtcatccgcgactcgaatacgataaccacgcgtcatcgccgcccccgccctaacgccccaaaacgaacccatacgccccccgccccactataacgcccaaaccccgccaaaaccgccccctccaaacgcaaaacgaaacccctccctacctaccgcccgaacctccaaaaaaaccgataaacgaacgaccccccaaaatcccgcaatcctttcccgctccgcgat

SEQ ID NO: 40267 - DNA, 664 bp, Artificial Sequence
  chemically treated genomic DNA (Homo sapiens) CpG-island No: 40267
agggtaggagttattttcgtcgaggtattggagtcgttggaggttgaaggggatgtcgattattaggtttagtttttttttgagttttcgtacggttatgtcgtcgcggtagtttgttattcggaatatttttttcgttttttttagtcgtattcgtaggacgaagacgttaggggttaagtcgggtaaggtattcgcggttttcgggttatagacgagtcgttggtttcggtcgcgggtataggttaggggttgcgcggggagggttcgcgagttcgtcgagtttattttgggttcgtcgtatttttgagtttcggttcgcgtatcgtttttgcgtttcgtattggggtgtaggcgagaggcgtttttagttggtttcgtcgttcgcgtttcgttcgttttcgtcgtcgttcgtcgtattttttaggcgcggtcgcgcgttattcgcggttcgagtgcggtggttacgcgttatcgtcgttttcgttttgacgttttaaggcgggtttatgcgtttttcgttttattgtgacgtttaggtttcgttaggatcgttttttttagacgtaaggcgaggtttttttttgtttgtcgttcgagtttttagggagatcgatgggcgggcggttttttaaggtttcgtagttttttttcgtttcgcgat

SEQ ID NO: 40268 - DNA, 664 bp, Artificial Sequence
  chemically treated genomic DNA (Homo sapiens) CpG-island No: 40268
atcgcgaaacgaaaaaaaactacgaaaccttaaaaaaccgcccgcccatcgatctccctaaaaactcgaacgacaaacaaaaaaaaacctcgccttacgtctaaaaaaaacgatcctaacgaaacctaaacgtcacaataaaacgaaaaacgcataaacccgccttaaaacgtcaaaacgaaaacgacgataacgcgtaaccaccgcactcgaaccgcgaataacgcgcgaccgcgcctaaaaaatacgacgaacgacgacgaaaacgaacgaaacgcgaacgacgaaaccaactaaaaacgcctctcgcctacaccccaatacgaaacgcaaaaacgatacgcgaaccgaaactcaaaaatacgacgaacccaaaataaactcgacgaactcgcgaaccctccccgcgcaacccctaacctatacccgcgaccgaaaccaacgactcgtctataacccgaaaaccgcgaataccttacccgacttaacccctaacgtcttcgtcctacgaatacgactaaaaaaaacgaaaaaaatattccgaataacaaactaccgcgacgacataaccgtacgaaaactcaaaaaaaaactaaacctaataatcgacatccccttcaacctccaacgactccaatacctcgacgaaaataactcctaccct

SEQ ID NO: 40269 - DNA, 859 bp, Artificial Sequence
  chemically treated genomic DNA (Homo sapiens) CpG-island No: 40269
gacgtgggaggcgtttttaggtgcgggtatagacgcggggatgtggggtgcggggatgtgggaggcgtttttaggtgtgggtgtagacgtggggagcggggacgtgggaggcgtttttaggtgcgggcgtagacgtggggacgtgggaggcgtttttaggtgcgggcgtagacgtggggacgtggggtgcggggacgtgggaggtgtttttaggtgtgggtgtagacgtgggaggcgtttttaggtgtgggcgtagatgtggggagtggggacgtgggaggcgtttttaggtgcggcgtagacgggacgtgggaggcgtttttaggtgtgggcgtagacgtggggtgcggggacgtgggaggtgtttttaggtgtgggtgtagacgtgggaggcgtttttaggtgtgggcgtagatgtggggagtggggacgtgggaggcgtttttaggtgtggacgtagacgggacgtgggaggcgtttttaggtgtgggcgtagacgtggggatttggggtgcggggacgtgggaggcgtttttaggtgcgggcgtagacgtggggacgtggggtgcggggacgtgggaggtgtttttaggtgtgggtgtagacgtggggtgcggggacgtgggaggcgtttttaggtgcggacgtagacgtggggacgtgggaggcgtttttaggtgtgggcgcggacgtggggagcggggacgtgggaggcgtttttaggggcgggcgtagatttgttatgtcgttatttttggttgtaggtgggaagttaagcgagtcgagtggttaagttgaaagtcgagggttagggagcgatgttttttttcgatgaggttacggcgaggggtagaggtag

SEQ ID NO: 40270 - DNA, 859 bp, Artificial Sequence
  chemically treated genomic DNA (Homo sapiens) CpG-island No: 40270
ctacctctacccctcgccgtaacctcatcgaaaaaaaacatcgctccctaaccctcgactttcaacttaaccactcgactcgcttaacttcccacctacaaccaaaaataacgacataacaaatctacgcccgcccctaaaaacgcctcccacgtccccgctccccacgtccgcgcccacacctaaaaacgcctcccacgtccccacgtctacgtccgcacctaaaaacgcctcccacgtccccgcaccccacgtctacacccacacctaaaaacacctcccacgtccccgcaccccacgtccccacgtctacgcccgcacctaaaaacgcctcccacgtccccgcaccccaaatccccacgtctacgcccacacctaaaaacgcctcccacgtcccgtctacgtccacacctaaaaacgcctcccacgtccccactccccacatctacgcccacacctaaaaacgcctcccacgtctacacccacacctaaaaacacctcccacgtccccgcaccccacgtctacgcccacacctaaaaacgcctcccacgtcccgtctacgccgcacctaaaaacgcctcccacgtccccactccccacatctacgcccacacctaaaaacgcctcccacgtctacacccacacctaaaaacacctcccacgtccccgcaccccacgtccccacgtctacgcccgcacctaaaaacgcctcccacgtccccacgtctacgcccgcacctaaaaacgcctcccacgtccccgctccccacgtctacacccacacctaaaaacgcctcccacatccccgcaccccacatccccgcgtctatacccgcacctaaaaacgcctcccacgtc

SEQ ID NO: 40271 - DNA, 859 bp, Artificial Sequence
  chemically treated genomic DNA (Homo sapiens) CpG-island No: 40271
ttgtttttgtttttcgtcgtggttttatcggagggaggtatcgttttttgattttcgatttttagtttggttattcgattcgtttggttttttatttatagttaggagtgacggtataataggtttgcgttcgtttttgaagacgttttttacgttttcgttttttacgttcgcgtttatatttgaagacgttttttacgtttttacgtttgcgttcgtatttgaagacgttttttacgttttcgtattttacgtttgtatttatatttgaagatattttttacgttttcgtattttacgtttttacgtttgcgttcgtatttgaagacgttttttacgttttcgtattttaagtttttacgtttgcgtttatatttgaagacgttttttacgtttcgtttgcgtttatatttgaagacgttttttacgtttttattttttatatttgcgtttatatttgaagacgttttttacgtttgtatttatatttgaagatattttttacgttttcgtattttacgtttgcgtttatatttgaagacgttttttacgtttcgtttgcgtcgtatttgaagacgttttttacgtttttattttttatatttgcgtttatatttgaagacgttttttacgtttgtatttatatttgaagatattttttacgttttcgtattttacgtttttacgtttgcgttcgtatttgaagacgttttttacgtttttacgtttgcgttcgtatttgaagacgttttttacgttttcgttttttacgtttgtatttatatttgaagacgttttttatattttcgtattttatattttcgcgtttgtgttcgtatttgaagacgttttttacgtt

SEQ ID NO: 40272 - DNA, 859 bp, Artificial Sequence
  chemically treated genomic DNA (Homo sapiens) CpG-island No: 40272
aacgtaaaaaacgtcttcaaatacgaacacaaacgcgaaaatataaaatacgaaaatataaaaaacgtcttcaaatataaatacaaacgtaaaaaacgaaaacgtaaaaaacgtcttcaaatacgaacgcaaacgtaaaaacgtaaaaaacgtcttcaaatacgaacgcaaacgtaaaaacgtaaaatacgaaaacgtaaaaaatatcttcaaatataaatacaaacgtaaaaaacgtcttcaaatataaacgcaaatataaaaaataaaaacgtaaaaaacgtcttcaaatacgacgcaaacgaaacgtaaaaaacgtcttcaaatataaacgcaaacgtaaaatacgaaaacgtaaaaaatatcttcaaatataaatacaaacgtaaaaaacgtcttcaaatataaacgcaaatataaaaaataaaaacgtaaaaaacgtcttcaaatataaacgcaaacgaaacgtaaaaaacgtcttcaaatataaacgcaaacgtaaaaacttaaaatacgaaaacgtaaaaaacgtcttcaaatacgaacgcaaacgtaaaaacgtaaaatacgaaaacgtaaaaaatatcttcaaatataaatacaaacgtaaaatacgaaaacgtaaaaaacgtcttcaaatacgaacgcaaacgtaaaaacgtaaaaaacgtcttcaaatataaacgcgaacgtaaaaaacgaaaacgtaaaaaacgtcttcaaaaacgaacgcaaacctattataccgtcactcctaactataaataaaaaaccaaacgaatcgaataaccaaactaaaaatcgaaaatcaaaaaacgatacctccctccgataaaaccacgacgaaaaacaaaaacaa

SEQ ID NO: 40273 - DNA, 1541 bp, Artificial Sequence
  chemically treated genomic DNA (Homo sapiens) CpG-island No: 40273
cgttttattttttcggatttttgttttttcggacgcgtggattttagttttcgtttgggtttttaaagcgttgaatttatggttatttttatgcgtagttttggtgttcgtcgtttatagtcggatcgtatttttcggttttcgtttaatttttggtttagttatacgagtgatagttttgttcgttcgggcgggcgacgtcgaggggtgggttcggttttatttgagtagttttttagcgtttttttgaaattcgtttgtggtttttggcgtcgtttttaggggtcgtcgtcgtttttttatgatatagtaataataggggtcgttttggtttaagcgttttgcggttcgcgttttcgtcggaaaagagtcgtcggcgcgggggcggatcggggaggagcgagtgcgatggacggtcgttttcgttaatcgttggtaggttagagtcggttgcgcggtttacggggtttaatcggcggcgagagcggtaggcggggcgggtcgaacgcgggttttcggcggggttcggtaggcgtcgaggaggaagagcgagttcggacggcgtttttcgaacgagtgtgggcgcgaggtaggtgcgggagtcgtcgggtttggggcggtcgggggcgatcggaggcgggggtaggggttgttggattaaggatggggcgggggtagttaagacgagaaggtggtcggcgcggcgggtggggtttgcgggggtcgggtcgggcgggggttttggggtttcgggcgtcgtttcggtttcgtttgcggttttgaacgtggggttcggcgggagttcgggcgggtttgtttcgcggagcgggtcgtcggggtggcgcgtcgaggttggtgtttcgcggagacggcgttaagtttagggtcggttttattaggtttggcggggttgtttcggtttagcgtcgagtgcgggcggtgcgatcgtcgtgagcggggtaaacgcggaaaggtagttcggcgtgtttgagtttgttttaggtagttttgggcgtaggttttttgttcgtaaatattttagggggcgggagtttgtcggatcgtaggcgatagtgatcgtcgcgttttagcgtttttttcgcgtttttaggatgacgattttaggcgcgttttttttaagtttggtgttaggttttcggggcgtttttaataagtatttggtggagtttcgggcgggaaagatgtttttgaaggggattatcgtgatttcggataagcggaaagggttggtgtatatttagtagacggacgattcgtttatttatttttgttggaaggataggacgttcgggaacgtggaagacgtgagtgtttttgagtcgtagtagtaggataggcgatttttcgggttttcggagttttcgttttggagttcgcggtgggggtttggtcgtatttggggatcgttcgtggggtcgttatcgattgttttgttgatgggtcgttttggttttcgcggtgataggggtatttcggttattgtgtattttgaattgttcgtgtgaggtgtttgggttgga

SEQ ID NO: 40274 - DNA, 1541 bp, Artificial Sequence
  chemically treated genomic DNA (Homo sapiens) CpG-island No: 40274
tccaacccaaacacctcacacgaacaattcaaaatacacaataaccgaaatacccctatcaccgcgaaaaccaaaacgacccatcaacaaaacaatcgataacgaccccacgaacgatccccaaatacgaccaaacccccaccgcgaactccaaaacgaaaactccgaaaacccgaaaaatcgcctatcctactactacgactcaaaaacactcacgtcttccacgttcccgaacgtcctatccttccaacaaaaataaataaacgaatcgtccgtctactaaatatacaccaaccctttccgcttatccgaaatcacgataatccccttcaaaaacatctttcccgcccgaaactccaccaaatacttattaaaaacgccccgaaaacctaacaccaaacttaaaaaaaacgcgcctaaaatcgtcatcctaaaaacgcgaaaaaaacgctaaaacgcgacgatcactatcgcctacgatccgacaaactcccgccccctaaaatatttacgaacaaaaaacctacgcccaaaactacctaaaacaaactcaaacacgccgaactacctttccgcgtttaccccgctcacgacgatcgcaccgcccgcactcgacgctaaaccgaaacaaccccgccaaacctaataaaaccgaccctaaacttaacgccgtctccgcgaaacaccaacctcgacgcgccaccccgacgacccgctccgcgaaacaaacccgcccgaactcccgccgaaccccacgttcaaaaccgcaaacgaaaccgaaacgacgcccgaaaccccaaaacccccgcccgacccgacccccgcaaaccccacccgccgcgccgaccaccttctcgtcttaactacccccgccccatccttaatccaacaacccctacccccgcctccgatcgcccccgaccgccccaaacccgacgactcccgcacctacctcgcgcccacactcgttcgaaaaacgccgtccgaactcgctcttcctcctcgacgcctaccgaaccccgccgaaaacccgcgttcgacccgccccgcctaccgctctcgccgccgattaaaccccgtaaaccgcgcaaccgactctaacctaccaacgattaacgaaaacgaccgtccatcgcactcgctcctccccgatccgcccccgcgccgacgactcttttccgacgaaaacgcgaaccgcaaaacgcttaaaccaaaacgacccctattattactatatcataaaaaaacgacgacgacccctaaaaacgacgccaaaaaccacaaacgaatttcaaaaaaacgctaaaaaactactcaaataaaaccgaacccacccctcgacgtcgcccgcccgaacgaacaaaactatcactcgtataactaaaccaaaaattaaacgaaaaccgaaaaatacgatccgactataaacgacgaacaccaaaactacgcataaaaataaccataaattcaacgctttaaaaacccaaacgaaaactaaaatccacgcgtccgaaaaaacaaaaatccgaaaaaataaaacg

SEQ ID NO: 40275 - DNA, 1541 bp, Artificial Sequence
  chemically treated genomic DNA (Homo sapiens) CpG-island No: 40275
tttaatttaggtattttatacggatagtttaagatatatagtggtcgagatgtttttgttatcgcggaaattaggacgatttattagtagggtagtcgatgacggttttacgagcggtttttagatgcggttaagtttttatcgcgaattttaaagcgaggatttcgagggttcgagaagtcgtttgttttgttgttgcggtttagggatatttacgttttttacgttttcggacgttttgtttttttagtagaagtgaataagcgagtcgttcgtttgttgaatgtatattagtttttttcgtttattcggagttacggtggttttttttagggatatttttttcgttcgaaattttattaagtatttgttggaggcgtttcgagagtttggtattaggtttggaaagagcgcgtttgaggtcgttattttgaaagcgcggagaggacgttgagacgcggcggttattgtcgtttgcggttcggtaagttttcgttttttggggtgtttgcgagtagggggtttgcgtttagagttgtttaaggtagatttagatacgtcgggttgttttttcgcgtttgtttcgtttacgacgatcgtatcgttcgtattcggcgttgggtcggggtagtttcgttaagtttagtggggtcggttttaggtttgacgtcgttttcgcggggtattagtttcgacgcgttatttcggcgattcgtttcgcggggtagattcgttcgagttttcgtcgagttttacgtttagagtcgtaggcggaatcggggcggcgttcgagattttagaattttcgttcggttcggttttcgtaggttttattcgtcgcgtcggttattttttcgttttggttgttttcgttttatttttggtttagtagtttttgttttcgttttcggtcgttttcggtcgttttaggttcggcgattttcgtatttgtttcgcgtttatattcgttcgagaggcgtcgttcgggttcgtttttttttttcggcgtttgtcgggtttcgtcggaaattcgcgttcggttcgtttcgtttgtcgttttcgtcgtcgattgagtttcgtaagtcgcgtagtcggttttaatttgttaacgattggcgagggcgatcgtttatcgtattcgttttttttcggttcgttttcgcgtcggcggttttttttcggcggaagcgcgggtcgtagggcgtttggattagagcggtttttattgttgttgtgttataggggagcggcggcggtttttagaggcggcgttagggattataggcgggttttagaggggcgttggggaattgtttaggtggggtcgagtttatttttcggcgtcgttcgttcgggcgggtagagttgttattcgtgtggttgagttaggggttaggcggaggtcgaggagtgcggttcggttgtgggcggcgggtattagggttacgtatagaagtgattatgggtttagcgttttggggatttaggcgggagttggagtttacgcgttcgggagagtaggggttcgggagggtagagcg

SEQ ID NO: 40276 - DNA, 1541 bp, Artificial Sequence
  chemically treated genomic DNA (Homo sapiens) CpG-island No: 40276
cgctctaccctcccgaacccctactctcccgaacgcgtaaactccaactcccgcctaaatccccaaaacgctaaacccataatcacttctatacgtaaccctaatacccgccgcccacaaccgaaccgcactcctcgacctccgcctaacccctaactcaaccacacgaataacaactctacccgcccgaacgaacgacgccgaaaaataaactcgaccccacctaaacaattccccaacgcccctctaaaacccgcctataatccctaacgccgcctctaaaaaccgccgccgctcccctataacacaacaacaataaaaaccgctctaatccaaacgccctacgacccgcgcttccgccgaaaaaaaaccgccgacgcgaaaacgaaccgaaaaaaaacgaatacgataaacgatcgccctcgccaatcgttaacaaattaaaaccgactacgcgacttacgaaactcaatcgacgacgaaaacgacaaacgaaacgaaccgaacgcgaatttccgacgaaacccgacaaacgccgaaaaaaaaaaacgaacccgaacgacgcctctcgaacgaatataaacgcgaaacaaatacgaaaatcgccgaacctaaaacgaccgaaaacgaccgaaaacgaaaacaaaaactactaaaccaaaaataaaacgaaaacaaccaaaacgaaaaaataaccgacgcgacgaataaaacctacgaaaaccgaaccgaacgaaaattctaaaatctcgaacgccgccccgattccgcctacgactctaaacgtaaaactcgacgaaaactcgaacgaatctaccccgcgaaacgaatcgccgaaataacgcgtcgaaactaataccccgcgaaaacgacgtcaaacctaaaaccgaccccactaaacttaacgaaactaccccgacccaacgccgaatacgaacgatacgatcgtcgtaaacgaaacaaacgcgaaaaaacaacccgacgtatctaaatctaccttaaacaactctaaacgcaaaccccctactcgcaaacaccccaaaaaacgaaaacttaccgaaccgcaaacgacaataaccgccgcgtctcaacgtcctctccgcgctttcaaaataacgacctcaaacgcgctctttccaaacctaataccaaactctcgaaacgcctccaacaaatacttaataaaatttcgaacgaaaaaaatatccctaaaaaaaaccaccgtaactccgaataaacgaaaaaaactaatatacattcaacaaacgaacgactcgcttattcacttctactaaaaaaacaaaacgtccgaaaacgtaaaaaacgtaaatatccctaaaccgcaacaacaaaacaaacgacttctcgaaccctcgaaatcctcgctttaaaattcgcgataaaaacttaaccgcatctaaaaaccgctcgtaaaaccgtcatcgactaccctactaataaatcgtcctaatttccgcgataacaaaaacatctcgaccactatatatcttaaactatccgtataaaatacctaaattaaa

SEQ ID NO: 40277 - DNA, 747 bp, Artificial Sequence
  chemically treated genomic DNA (Homo sapiens) CpG-island No: 40277
agttttgtcggtcgtttggttttagattcgtcgggttttcgtcgcgcgcgttgtttttggagttcggggacgcggttcggagtcgggaagatggcgaagcggttttgcgcggggagcgtattgtgtgttcgcggttttcggggtttcgcgtcgttgttgttggtcgggttggcgttgttgggcgcggcgcgggcgcgggaggaggcgggcggcggttttagtttgtattcgttttattttaatttggtcgagggcgttcgtatcgtcgttttcgcgatttgcggagaggaggtttcggcgcgcggtttttcgcgttttatcgaggatttttattgtaagttggtagggggtttcgtggtcggcggcgattttaattagattattcgggtgagcgtaggggcgggtcgtggggttttttttcggggtattcggattcggaatatcggttcgattttagggggagcgtcgtggttcggggcgagtttaggtgcggattttttggtttcgtattttgggggtttaagaaggtatttcgattcggtcgtttcgtttcggtcgggaaatttcgcgttttttcgggaaggcggaattaaagttttcggtatggattcgggggcggttgggcgtcggtttagttcgattgcggtgatcggggcgggaggggggtcgggtttagtttttggcggttttaagttcgggatttcggggagggcgggatttggttttcgtcgtttgttgtcggtgggg

SEQ ID NO: 40278 - DNA, 747 bp, Artificial Sequence
  chemically treated genomic DNA (Homo sapiens) CpG-island No: 40278
ccccaccgacaacaaacgacgaaaaccaaatcccgccctccccgaaatcccgaacttaaaaccgccaaaaactaaacccgacccccctcccgccccgatcaccgcaatcgaactaaaccgacgcccaaccgcccccgaatccataccgaaaactttaattccgccttcccgaaaaaacgcgaaatttcccgaccgaaacgaaacgaccgaatcgaaataccttcttaaacccccaaaatacgaaaccaaaaaatccgcacctaaactcgccccgaaccacgacgctccccctaaaatcgaaccgatattccgaatccgaataccccgaaaaaaaaccccacgacccgcccctacgctcacccgaataatctaattaaaatcgccgccgaccacgaaaccccctaccaacttacaataaaaatcctcgataaaacgcgaaaaaccgcgcgccgaaacctcctctccgcaaatcgcgaaaacgacgatacgaacgccctcgaccaaattaaaataaaacgaatacaaactaaaaccgccgcccgcctcctcccgcgcccgcgccgcgcccaacaacgccaacccgaccaacaacaacgacgcgaaaccccgaaaaccgcgaacacacaatacgctccccgcgcaaaaccgcttcgccatcttcccgactccgaaccgcgtccccgaactccaaaaacaacgcgcgcgacgaaaacccgacgaatctaaaaccaaacgaccgacaaaact

SEQ ID NO: 40279 - DNA, 747 bp, Artificial Sequence
  chemically treated genomic DNA (Homo sapiens) CpG-island No: 40279
ttttatcggtagtaggcggcggaggttaagtttcgtttttttcgggatttcggatttggggtcgttagggattgggttcggtttttttttcgtttcggttatcgtagtcgaattggatcggcgtttagtcgttttcgggtttatgtcggggattttaatttcgttttttcggagggacgcgaagtttttcggtcgagacggagcggtcgggtcggggtgtttttttgggtttttaaaatgcggaattagagagttcgtatttggattcgtttcgggttacggcgttttttttggggtcgggtcggtgtttcgggttcgagtgtttcgggaggaagttttacggttcgtttttgcgtttattcggatggtttggttggggtcgtcgtcggttacggggttttttattagtttgtagtaaaggttttcggtggggcgcggggagtcgcgcgtcggggtttttttttcgtaggtcgcggaggcggcgatgcgggcgttttcggttaggttgaagtagggcgggtgtaggttgaagtcgtcgttcgttttttttcgcgttcgcgtcgcgtttagtagcgttagttcgattagtagtagcggcgcggggtttcgggggtcgcgaatatatagtgcgtttttcgcgtagagtcgtttcgttattttttcggtttcgggtcgcgttttcgagttttagggatagcgcgcgcggcgggagttcggcgggtttgaagttaggcggtcggtagggtt

SEQ ID NO: 40280 - DNA, 747 bp, Artificial Sequence
  chemically treated genomic DNA (Homo sapiens) CpG-island No: 40280
aaccctaccgaccgcctaacttcaaacccgccgaactcccgccgcgcgcgctatccctaaaactcgaaaacgcgacccgaaaccgaaaaaataacgaaacgactctacgcgaaaaacgcactatatattcgcgacccccgaaaccccgcgccgctactactaatcgaactaacgctactaaacgcgacgcgaacgcgaaaaaaaacgaacgacgacttcaacctacacccgccctacttcaacctaaccgaaaacgcccgcatcgccgcctccgcgacctacgaaaaaaaaaccccgacgcgcgactccccgcgccccaccgaaaacctttactacaaactaataaaaaaccccgtaaccgacgacgaccccaaccaaaccatccgaataaacgcaaaaacgaaccgtaaaacttcctcccgaaacactcgaacccgaaacaccgacccgaccccaaaaaaaacgccgtaacccgaaacgaatccaaatacgaactctctaattccgcattttaaaaacccaaaaaaacaccccgacccgaccgctccgtctcgaccgaaaaacttcgcgtccctccgaaaaaacgaaattaaaatccccgacataaacccgaaaacgactaaacgccgatccaattcgactacgataaccgaaacgaaaaaaaaaccgaacccaatccctaacgaccccaaatccgaaatcccgaaaaaaacgaaacttaacctccgccgcctactaccgataaaa

SEQ ID NO: 40281 - DNA, 763 bp, Artificial Sequence
  chemically treated genomic DNA (Homo sapiens) CpG-island No: 40281
cgtggtgttgtcggcgtcgggcggggcgggggcggggagggggcggggcgagggcggtagttaatggcgggggcgttgcgcggggcgcgcggggcggtgggttgggcgcggggcgtattcggttgcgcgttgcgtttcggttgtacggtcgtatcggtagcggtttaggtttcggtttttttttcgttgtagtagtcgcgttgtcggttttattgggttcggattcggtttcggttttttcggtatcgtttgttttggtttcggtttcggtttcgcggattatgcgttgggcgtttttaggggaattcgattcggttaagggttcgtaaagacgaggttttcgggtcggggtttttttcggtcgtttagttttcggtcggcgttttgtttcgcgtttcggagtcgcgtgagtttgcggggttatggagcgcgcgtcgttcgacgggtcgttgaacgtttcgggggcgttggcgggcgaggcggcggcggcgggcggggcgcgcggtttttcggtagtttggatcgcggtgttggtcgcgtttatggcgttgtttatcgtggttacggtgttgggtaacgcgttggttatgttcgttttcgtggtcgattcgagttttcgtatttagaataatttttttttgtttaatttcgttattttcgattttttcgtcggtaaatttttagtttttggtcgttggggatttaggggcgtttagcgtggtcgggttagcggggattggaatacggatttgggtggttttcg

SEQ ID NO: 40282 - DNA, 763 bp, Artificial Sequence
  chemically treated genomic DNA (Homo sapiens) CpG-island No: 40282
cgaaaaccacccaaatccgtattccaatccccgctaacccgaccacgctaaacgcccctaaatccccaacgaccaaaaactaaaaatttaccgacgaaaaaatcgaaaataacgaaattaaacaaaaaaaaattattctaaatacgaaaactcgaatcgaccacgaaaacgaacataaccaacgcgttacccaacaccgtaaccacgataaacaacgccataaacgcgaccaacaccgcgatccaaactaccgaaaaaccgcgcgccccgcccgccgccgccgcctcgcccgccaacgcccccgaaacgttcaacgacccgtcgaacgacgcgcgctccataaccccgcaaactcacgcgactccgaaacgcgaaacaaaacgccgaccgaaaactaaacgaccgaaaaaaaccccgacccgaaaacctcgtctttacgaacccttaaccgaatcgaattcccctaaaaacgcccaacgcataatccgcgaaaccgaaaccgaaaccaaaacaaacgataccgaaaaaaccgaaaccgaatccgaacccaataaaaccgacaacgcgactactacaacgaaaaaaaaaccgaaacctaaaccgctaccgatacgaccgtacaaccgaaacgcaacgcgcaaccgaatacgccccgcgcccaacccaccgccccgcgcgccccgcgcaacgcccccgccattaactaccgccctcgccccgccccctccccgcccccgccccgcccgacgccgacaacaccacg

SEQ ID NO: 40283 - DNA, 763 bp, Artificial Sequence
  chemically treated genomic DNA (Homo sapiens) CpG-island No: 40283
cgggagttatttaggttcgtgttttagttttcgttggttcggttacgttgggcgtttttgggtttttagcggttaggggttggggatttatcgacgaggaagtcggagatggcgaggttgagtaggaagaagttgttttgggtgcggaggttcgagtcggttacgaaggcgagtatgattagcgcgttgtttagtatcgtggttacgatgagtagcgttatgagcgcggttagtatcgcggtttaggttgtcgagaagtcgcgcgtttcgttcgtcgtcgtcgtttcgttcgttagcgttttcgaagcgtttagcggttcgtcgggcggcgcgcgttttatggtttcgtaggtttacgcggtttcgggacgcggggtagggcgtcggtcgagagttgggcggtcgggaggggtttcggttcgggagtttcgtttttgcgggtttttggtcgggtcgggtttttttgggggcgtttagcgtatggttcgcggggtcggggtcggggttagagtaggcggtgtcgagggggtcggggtcggattcgagtttagtggggtcggtagcgcggttgttgtagcgggagaggagtcggagtttgagtcgttgtcggtgcgatcgtgtagtcggagcgtaacgcgtagtcgagtgcgtttcgcgtttagtttatcgtttcgcgcgtttcgcgtagcgttttcgttattggttgtcgttttcgtttcgtttttttttcgttttcgtttcgttcggcgtcggtagtattacg

SEQ ID NO: 40284 - DNA, 763 bp, Artificial Sequence
  chemically treated genomic DNA (Homo sapiens) CpG-island No: 40284
cgtaatactaccgacgccgaacgaaacgaaaacgaaaaaaaaacgaaacgaaaacgacaaccaataacgaaaacgctacgcgaaacgcgcgaaacgataaactaaacgcgaaacgcactcgactacgcgttacgctccgactacacgatcgcaccgacaacgactcaaactccgactcctctcccgctacaacaaccgcgctaccgaccccactaaactcgaatccgaccccgaccccctcgacaccgcctactctaaccccgaccccgaccccgcgaaccatacgctaaacgcccccaaaaaaacccgacccgaccaaaaacccgcaaaaacgaaactcccgaaccgaaacccctcccgaccgcccaactctcgaccgacgccctaccccgcgtcccgaaaccgcgtaaacctacgaaaccataaaacgcgcgccgcccgacgaaccgctaaacgcttcgaaaacgctaacgaacgaaacgacgacgacgaacgaaacgcgcgacttctcgacaacctaaaccgcgatactaaccgcgctcataacgctactcatcgtaaccacgatactaaacaacgcgctaatcatactcgccttcgtaaccgactcgaacctccgcacccaaaacaacttcttcctactcaacctcgccatctccgacttcctcgtcgataaatccccaacccctaaccgctaaaaacccaaaaacgcccaacgtaaccgaaccaacgaaaactaaaacacgaacctaaataactcccg

SEQ ID NO: 40285 - DNA, 619 bp, Artificial Sequence
  chemically treated genomic DNA (Homo sapiens) CpG-island No: 40285
agttatcgtcgtttttttttattttatttttttagttgtttttagatttttgggtttttttagcgtcgtcgtatttttttttttcgtttttgaggttatcgtatattattttgttaacggtcgagggtttcggtggtgtacgttaggtggttgttttagtttcgtcgttttcgtcgtcgtcgttaggggcgttggtgtgtgtggtgtggtgtgcgtgtgtgggggcggaaggtagcggtagttttcgttaattattgttgtttattttggtcgagtttagtcgcgttttgggcgttattttattttggcggcggtttatttgtttcggttgttattgcgttgtcgttagttgagttttcgatgggttcggacgtgtgcggcggcggcggttgagattgggggagaagggaaagcggacgaggagcggcgggcgtagtggaggtagtggggagcgtcggggtttgacgaggaggttcgaggggtcgggcgtttgggcggtagagattcggtttgtcgaagcgggtggagggagaaggtttaattcgaatcgttggggttttattttggattatttttagtcgttattttgttttttttcgtttaatatattaatgatttt

SEQ ID NO: 40286 - DNA, 619 bp, Artificial Sequence
  chemically treated genomic DNA (Homo sapiens) CpG-island No: 40286
aaaatcattaatatattaaacgaaaaaaaacaaaataacgactaaaaataatccaaaataaaaccccaacgattcgaattaaaccttctccctccacccgcttcgacaaaccgaatctctaccgcccaaacgcccgacccctcgaacctcctcgtcaaaccccgacgctccccactacctccactacgcccgccgctcctcgtccgctttcccttctcccccaatctcaaccgccgccgccgcacacgtccgaacccatcgaaaactcaactaacgacaacgcaataacaaccgaaacaaataaaccgccgccaaaataaaataacgcccaaaacgcgactaaactcgaccaaaataaacaacaataattaacgaaaactaccgctaccttccgcccccacacacgcacaccacaccacacacaccaacgcccctaacgacgacgacgaaaacgacgaaactaaaacaaccacctaacgtacaccaccgaaaccctcgaccgttaacaaaataatatacgataacctcaaaaacgaaaaaaaaaaatacgacgacgctaaaaaaacccaaaaatctaaaaacaactaaaaaaataaaataaaaaaaaacgacgataact

SEQ ID NO: 40287 - DNA, 619 bp, Artificial Sequence
  chemically treated genomic DNA (Homo sapiens) CpG-island No: 40287
agaattattagtatattgaacgggaagaaataagatggcggttgaaggtgatttagagtggggttttagcgattcggattgagttttttttttttattcgtttcggtaggtcgggtttttatcgtttaggcgttcggtttttcgggttttttcgttaggtttcggcgttttttattgtttttattgcgttcgtcgtttttcgttcgttttttttttttttttagttttagtcgtcgtcgtcgtatacgttcgaatttatcgggggtttagttagcggtaacgtagtagtagtcggggtaggtgggtcgtcgttaggatgaggtggcgtttaagacgcggttgagttcggttagggtgggtagtagtagttggcggaagttgtcgttgtttttcgtttttatatacgtatattatattatatatattagcgtttttggcggcggcggcgggggcggcggggttggggtagttatttggcgtgtattatcgaggttttcggtcgttaataaagtggtatacgatgattttaagagcgaggaggaggagtacggcgacgttgaggagatttaggagtttgaggataattaggaggatgagatggaggaggacgacgatgatt

SEQ ID NO: 40288 - DNA, 619 bp, Artificial Sequence
  chemically treated genomic DNA (Homo sapiens) CpG-island No: 40288
aatcatcgtcgtcctcctccatctcatcctcctaattatcctcaaactcctaaatctcctcaacgtcgccgtactcctcctcctcgctcttaaaatcatcgtataccactttattaacgaccgaaaacctcgataatacacgccaaataactaccccaaccccgccgcccccgccgccgccgccaaaaacgctaatatatataatataatatacgtatataaaaacgaaaaacaacgacaacttccgccaactactactacccaccctaaccgaactcaaccgcgtcttaaacgccacctcatcctaacgacgacccacctaccccgactactactacgttaccgctaactaaacccccgataaattcgaacgtatacgacgacgacgactaaaactaaaaaaaaaaaaaaaacgaacgaaaaacgacgaacgcaataaaaacaataaaaaacgccgaaacctaacgaaaaaacccgaaaaaccgaacgcctaaacgataaaaacccgacctaccgaaacgaataaaaaaaaaaaactcaatccgaatcgctaaaaccccactctaaatcaccttcaaccgccatcttatttcttcccgttcaatatactaataattct

SEQ ID NO: 40289 - DNA, 937 bp, Artificial Sequence
  chemically treated genomic DNA (Homo sapiens) CpG-island No: 40289
atttcgcgttttagtttcgcgtcgagtttttcggcggcgtttttagggtagggcgaggagcgcggggagaggtcgcggggattcgggtcgttggggtcgtggggttcgttcggtcgtcggtcggttttttggggcgcgggcggttgcgttagcggggggcggagacgcggcgttgttttcgtttacgcgcgttttgttttttttttttagtcgttttggttcgcggcgtttaacggggaagacgaagatgtagggatacgcgcgaggagtcgtcgtagtcgtcgtcgtcgcgttgtggagttcgagtgagcgcggcgttagttcgttcggtcgttggataatatggaggttgtattgttcgggtcgtcgtggtcgttgttgttggcgttgtgcggttgttcggttttcgtcgtaggtaggtgggcgcgggtcgattcgggatcgcgggttgttagtataatggttcgggcggtttcgcgattaagtgtacgggcgttatcgtcgttttggaagcgagttgggggcgagttggggcgcgtatcggggattttttcgtcgtttttgttcgggttattttcggggacgtcgcgtttcgggtcggtgaggagggcgcgcgggcggcgtcggtcggtttttatttgttcgcgttcgtaggaagttaggagtcgagttcgcgttgggttcgtgtggttcgggtcgggtattaagttgggatttggggttcggaggcgggtttggttcggggagtcggttcgcgattttgtttttagcggtcgcgcggtcggttcgtgtgtttcgaggatcggttgaggttgtagcgagaaagttttgagttcgggtgcggggttgtttggtcggtggcgttgtttttgtgagtcgtggttgtgggtttttaagcggattgatatatgttaggtgtcggggcgattcgaatgtt

SEQ ID NO: 40290 - DNA, 937 bp, Artificial Sequence
  chemically treated genomic DNA (Homo sapiens) CpG-island No: 40290
aacattcgaatcgccccgacacctaacatatatcaatccgcttaaaaacccacaaccacgactcacaaaaacaacgccaccgaccaaacaaccccgcacccgaactcaaaactttctcgctacaacctcaaccgatcctcgaaacacacgaaccgaccgcgcgaccgctaaaaacaaaatcgcgaaccgactccccgaaccaaacccgcctccgaaccccaaatcccaacttaatacccgacccgaaccacacgaacccaacgcgaactcgactcctaacttcctacgaacgcgaacaaataaaaaccgaccgacgccgcccgcgcgccctcctcaccgacccgaaacgcgacgtccccgaaaataacccgaacaaaaacgacgaaaaaatccccgatacgcgccccaactcgcccccaactcgcttccaaaacgacgataacgcccgtacacttaatcgcgaaaccgcccgaaccattatactaacaacccgcgatcccgaatcgacccgcgcccacctacctacgacgaaaaccgaacaaccgcacaacgccaacaacaacgaccacgacgacccgaacaatacaacctccatattatccaacgaccgaacgaactaacgccgcgctcactcgaactccacaacgcgacgacgacgactacgacgactcctcgcgcgtatccctacatcttcgtcttccccgttaaacgccgcgaaccaaaacgactaaaaaaaaaaaacaaaacgcgcgtaaacgaaaacaacgccgcgtctccgccccccgctaacgcaaccgcccgcgccccaaaaaaccgaccgacgaccgaacgaaccccacgaccccaacgacccgaatccccgcgacctctccccgcgctcctcgccctaccctaaaaacgccgccgaaaaactcgacgcgaaactaaaacgcgaaat

SEQ ID NO: 40291 - DNA, 937 bp, Artificial Sequence
  chemically treated genomic DNA (Homo sapiens) CpG-island No: 40291
ggtattcgggtcgtttcggtatttggtatgtgttagttcgtttggaaatttatagttacggtttataggggtagcgttatcggttaggtagtttcgtattcgggtttagaattttttcgttgtaattttagtcggttttcggagtatacgggtcggtcgcgcggtcgttggaaatagagtcgcgaatcggtttttcgggttaggttcgttttcgggttttaagttttaatttggtgttcggttcgggttatacgggtttagcgcgggttcggtttttggttttttacgggcgcgggtaggtgaggatcggtcggcgtcgttcgcgcgttttttttatcggttcgggacgcggcgttttcggggatggttcgggtagggacggcggggggattttcggtgcgcgttttaattcgtttttaattcgtttttaaggcggcggtggcgttcgtgtatttggtcgcggggtcgttcgggttattgtattagtagttcgcggtttcgggtcggttcgcgtttatttatttgcggcgggggtcgggtagtcgtatagcgttagtagtagcggttacggcggttcgggtagtgtagtttttatgttgtttagcggtcggacgggttggcgtcgcgtttattcgggttttatagcgcggcggcggcggttgcggcggtttttcgcgcgtgtttttgtattttcgtttttttcgttgggcgtcgcggattaggacgattgggaggagggagtagggcgcgcgtgagcggaagtagcgtcgcgttttcgtttttcgttgacgtagtcgttcgcgttttagggagtcggtcggcggtcgggcgggttttacggttttagcggttcgggttttcgcggttttttttcgcgtttttcgttttgttttgggggcgtcgtcgggaggttcggcgcggggttggggcgcggggt

SEQ ID NO: 40292 - DNA, 937 bp, Artificial Sequence
  chemically treated genomic DNA (Homo sapiens) CpG-island No: 40292
accccgcgccccaaccccgcgccgaacctcccgacgacgcccccaaaacaaaacgaaaaacgcgaaaaaaaaccgcgaaaacccgaaccgctaaaaccgtaaaacccgcccgaccgccgaccgactccctaaaacgcgaacgactacgtcaacgaaaaacgaaaacgcgacgctacttccgctcacgcgcgccctactccctcctcccaatcgtcctaatccgcgacgcccaacgaaaaaaacgaaaatacaaaaacacgcgcgaaaaaccgccgcaaccgccgccgccgcgctataaaacccgaataaacgcgacgccaacccgtccgaccgctaaacaacataaaaactacactacccgaaccgccgtaaccgctactactaacgctatacgactacccgacccccgccgcaaataaataaacgcgaaccgacccgaaaccgcgaactactaatacaataacccgaacgaccccgcgaccaaatacacgaacgccaccgccgccttaaaaacgaattaaaaacgaattaaaacgcgcaccgaaaatccccccgccgtccctacccgaaccatccccgaaaacgccgcgtcccgaaccgataaaaaaaacgcgcgaacgacgccgaccgatcctcacctacccgcgcccgtaaaaaaccaaaaaccgaacccgcgctaaacccgtataacccgaaccgaacaccaaattaaaacttaaaacccgaaaacgaacctaacccgaaaaaccgattcgcgactctatttccaacgaccgcgcgaccgacccgtatactccgaaaaccgactaaaattacaacgaaaaaattctaaacccgaatacgaaactacctaaccgataacgctacccctataaaccgtaactataaatttccaaacgaactaacacataccaaataccgaaacgacccgaatacc

SEQ ID NO: 40293 - DNA, 529 bp, Artificial Sequence
  chemically treated genomic DNA (Homo sapiens) CpG-island No: 40293
gtatcgtcgtttagcgaggtgggcgttttttcgggatttcggcggtcgttcgcgggcggcgatttcggtttttttgggttcgcgcgggggcggggagttcggtttttttttttttttttttttttttttttttttttgttcggttgttttgcgcgggggcgggggcgggggcggagcgcgcgggcgggattttttcgtttttttttttcggttttcgggaaatttagttttcgtggtttggtcgtttttcgttttcgcgttcgttgtcgttcggcgttcgtttggggtttcgtagtcggcgcggttttttagttgggggtttcgtagtgtcgggtttcggtttttgttcgtttgtttaacgtcgtagtgttttcggttcgggtcgtcggtattatgtaattcggtcggagttcgagtcgggttaggtaagtcgcggggaggagtggggacggggaaacgttatgggattattttatatcgttttttatttaaaggtagaagtcgttttcgtagttatttattttttttt

SEQ ID NO: 40294 - DNA, 529 bp, Artificial Sequence
  chemically treated genomic DNA (Homo sapiens) CpG-island No: 40294
aaaaaaaaataaataactacgaaaacgacttctacctttaaataaaaaacgatataaaataatcccataacgtttccccgtccccactcctccccgcgacttacctaacccgactcgaactccgaccgaattacataataccgacgacccgaaccgaaaacactacgacgttaaacaaacgaacaaaaaccgaaacccgacactacgaaacccccaactaaaaaaccgcgccgactacgaaaccccaaacgaacgccgaacgacaacgaacgcgaaaacgaaaaacgaccaaaccacgaaaactaaatttcccgaaaaccgaaaaaaaaaaacgaaaaaatcccgcccgcgcgctccgcccccgcccccgcccccgcgcaaaacaaccgaacaaaaaaaaaaaaaaaaaaaaaaaaaaaaaaaaaaaccgaactccccgcccccgcgcgaacccaaaaaaaccgaaatcgccgcccgcgaacgaccgccgaaatcccgaaaaaacgcccacctcgctaaacgacgatac

SEQ ID NO: 40295 - DNA, 529 bp, Artificial Sequence
  chemically treated genomic DNA (Homo sapiens) CpG-island No: 40295
gagggggagtgggtggttgcgggggcggtttttgtttttgggtggggggcgatgtggagtaattttataacgttttttcgtttttattttttttcgcggtttatttggttcggttcgggtttcggtcgggttatatggtgtcggcggttcgggtcgggggtattgcggcgttgggtaggcgggtagggatcggggttcggtattgcggagtttttagttgaggggtcgcgtcggttgcggagttttaagcgagcgtcgagcggtagcgggcgcgggagcgggaggcggttaagttacggaggttggatttttcggggatcgggaaggggaggcggggggatttcgttcgcgcgtttcgttttcgttttcgttttcgcgtagggtagtcgagtagggagagggagagggagaggaagagggagggggatcgagtttttcgttttcgcgcggatttaggagggtcgaggtcgtcgttcgcgggcggtcgtcggggtttcggaggagcgtttatttcgttgagcgacggtgt

SEQ ID NO: 40296 - DNA, 529 bp, Artificial Sequence
  chemically treated genomic DNA (Homo sapiens) CpG-island No: 40296
acaccgtcgctcaacgaaataaacgctcctccgaaaccccgacgaccgcccgcgaacgacgacctcgaccctcctaaatccgcgcgaaaacgaaaaactcgatccccctccctcttcctctccctctccctctccctactcgactaccctacgcgaaaacgaaaacgaaaacgaaacgcgcgaacgaaatccccccgcctccccttcccgatccccgaaaaatccaacctccgtaacttaaccgcctcccgctcccgcgcccgctaccgctcgacgctcgcttaaaactccgcaaccgacgcgacccctcaactaaaaactccgcaataccgaaccccgatccctacccgcctacccaacgccgcaatacccccgacccgaaccgccgacaccatataacccgaccgaaacccgaaccgaaccaaataaaccgcgaaaaaaaataaaaacgaaaaaacgttataaaattactccacatcgccccccacccaaaaacaaaaaccgcccccgcaaccacccactccccctc

SEQ ID NO: 40297 - DNA, 632 bp, Artificial Sequence
  chemically treated genomic DNA (Homo sapiens) CpG-island No: 40297
tattcggaggggcgggttattcggggggacgaaggagtcggggaaggcggattaatagtcggggacgggatcgaagtgttttatggacgaagcgagcgtattgcgaggggataggggacggggagagggtggggtgggggggttgcggtaacggtacgggggttttttggaacgttgggggagtatgttatggggggggagaggagggcggagtatatagtgtgggaggttacggtaggtggatgggtagcgtcgtgagtcggggggggataggattaaataaggtgggaagtaggggcgtcggtacggtaggagattttcgggggattcgttgcgggtgatagggtgttgagttaggttcgtgtttttgatcgtagtgtcgttgttgatgaggggcgtcgggtgttggtgtggatgttgtcgcgtcgtatgttgtggtatattgttttcgttatcgttatttttcgtagcgtttacgtacggtatgatttttattgttagtttggttttttttttagtatatatcgttttttttttagtatatatcgcgatatatttttaagttagacgtggcgcggtttgtaacgattagggatttatatggatttaattgggatttgtatggatttgat

SEQ ID NO: 40298 - DNA, 632 bp, Artificial Sequence
  chemically treated genomic DNA (Homo sapiens) CpG-island No: 40298
atcaaatccatacaaatcccaattaaatccatataaatccctaatcgttacaaaccgcgccacgtctaacttaaaaatatatcgcgatatatactaaaaaaaaaacgatatatactaaaaaaaaaaccaaactaacaataaaaatcataccgtacgtaaacgctacgaaaaataacgataacgaaaacaatataccacaacatacgacgcgacaacatccacaccaacacccgacgcccctcatcaacaacgacactacgatcaaaaacacgaacctaactcaacaccctatcacccgcaacgaatcccccgaaaatctcctaccgtaccgacgcccctacttcccaccttatttaatcctatccccccccgactcacgacgctacccatccacctaccgtaacctcccacactatatactccgccctcctctccccccccataacatactcccccaacgttccaaaaaacccccgtaccgttaccgcaacccccccaccccaccctctccccgtcccctatcccctcgcaatacgctcgcttcgtccataaaacacttcgatcccgtccccgactattaatccgccttccccgactccttcgtccccccgaataacccgcccctccgaata

SEQ ID NO: 40299 - DNA, 632 bp, Artificial Sequence
  chemically treated genomic DNA (Homo sapiens) CpG-island No: 40299
attaggtttatatagattttaattagatttatatagatttttgatcgttgtaggtcgcgttacgtttggtttagaagtgtatcgcgatgtgtgttggagggaaaacgatgtgtgttgaagggggaattaaattggtaatggagattatgtcgtacgtgaacgttgcgggaaatggcggtggcgggggtaatgtgttatagtatgcgacgcgataatatttatattaatattcgacgttttttattaataacgatattacgattaaaaatacgaatttagtttaatattttattattcgtagcgaatttttcgagaattttttatcgtatcgacgtttttattttttattttgtttgattttattttttttcggtttacgacgttgtttatttatttgtcgtggttttttatattgtatgtttcgtttttttttttttttttataatatatttttttagcgttttaaagagttttcgtatcgttgtcgtaatttttttattttatttttttttcgttttttattttttcgtaatgcgttcgtttcgtttatggaatatttcggtttcgttttcgattgttggttcgtttttttcggttttttcgttttttcggatagttcgttttttcgagta

SEQ ID NO: 40300 - DNA, 632 bp, Artificial Sequence
  chemically treated genomic DNA (Homo sapiens) CpG-island No: 40300
tactcgaaaaaacgaactatccgaaaaaacgaaaaaaccgaaaaaaacgaaccaacaatcgaaaacgaaaccgaaatattccataaacgaaacgaacgcattacgaaaaaataaaaaacgaaaaaaaaataaaataaaaaaattacgacaacgatacgaaaactctttaaaacgctaaaaaaatatattataaaaaaaaaaaaaaaaacgaaacatacaatataaaaaaccacgacaaataaataaacaacgtcgtaaaccgaaaaaaaataaaatcaaacaaaataaaaaataaaaacgtcgatacgataaaaaattctcgaaaaattcgctacgaataataaaatattaaactaaattcgtatttttaatcgtaatatcgttattaataaaaaacgtcgaatattaatataaatattatcgcgtcgcatactataacacattacccccgccaccgccatttcccgcaacgttcacgtacgacataatctccattaccaatttaattcccccttcaacacacatcgttttccctccaacacacatcgcgatacacttctaaaccaaacgtaacgcgacctacaacgatcaaaaatctatataaatctaattaaaatctatataaacctaat

SEQ ID NO: 40301 - DNA, 507 bp, Artificial Sequence
  chemically treated genomic DNA (Homo sapiens) CpG-island No: 40301
  misc_feature (389)..(389): n is either a, c, g or t
gtcggttttattgtagacgttcgttattcgattatttcgtgggtttttttttttttttatttgattttttattttagtcgtttagcgtttttttttcgttttttttcgtttttttttttttttttattaattgtttcgttgttttttgcgcgtatttttttattcgtttaattttgtttttttattttttttttttttttcgtttttttttatgttttcgttattttgtgtagttcgacgtttcgcgtcgttgtcgttatatgttatttttatttcgttaattattacgtcgaattatcgtcgtgtacgtcgttgttcgatttaatttatttcgtttttattttttcgttttttaattttgatcgttttcgaaaatttattgttcgttntcgttatttataaatttgtttacgtttatcgttcgagaataatggtttattgtttcgtattattttttttttaatttatacgtgttcgttttttgttttttttcgttttatttatttt

SEQ ID NO: 40302 - DNA, 507 bp, Artificial Sequence
  chemically treated genomic DNA (Homo sapiens) CpG-island No: 40302
  misc_feature (119)..(119): n is either a, c, g or t
aaaataaataaaacgaaaaaaaacaaaaaacgaacacgtataaattaaaaaaaaaataatacgaaacaataaaccattattctcgaacgataaacgtaaacaaatttataaataacganaacgaacaataaattttcgaaaacgatcaaaattaaaaaacgaaaaaataaaaacgaaataaattaaatcgaacaacgacgtacacgacgataattcgacgtaataattaacgaaataaaaataacatataacgacaacgacgcgaaacgtcgaactacacaaaataacgaaaacataaaaaaaaacgaaaaaaaaaaaaaaaataaaaaaacaaaattaaacgaataaaaaaatacgcgcaaaaaacaacgaaacaattaataaaaaaaaaaaaaaaaacgaaaaaaaacgaaaaaaaaacgctaaacgactaaaataaaaaatcaaataaaaaaaaaaaaaaacccacgaaataatcgaataacgaacgtctacaataaaaccgac

SEQ ID NO: 40303 - DNA, 507 bp, Artificial Sequence
  chemically treated genomic DNA (Homo sapiens) CpG-island No: 40303
  misc_feature (119)..(119): n is either a, c, g or t
agagtaggtggggcgggaaggggtaagagacggatacgtgtgggttgaggggaagatagtgcggagtaataagttattgttttcgagcggtgggcgtgggtaaatttataggtggcggnggcgagtagtggattttcgggagcggttagagttagaaggcgagagagtgggagcgggatgagttgagtcgggtagcggcgtgtacgacggtggttcgacgtggtaattaacggagtaggaataatatgtggcgatagcggcgcgggacgtcgggttatataggatggcggaggtatgggggggagcggaggaaaggaggggaataggggggtagggttgggcgagtgggaaggtgcgcgtagaaggtagcgaggtagttggtaggggggggagaaggggcgaaggggggcgggggggagacgttgggcgattaaaatagggggttaagtggagagaagaggagatttacgagatgatcgggtggcgggcgtttataatgagatcggt

SEQ ID NO: 40304 - DNA, 507 bp, Artificial Sequence
  chemically treated genomic DNA (Homo sapiens) CpG-island No: 40304
  misc_feature (389)..(389): n is either a, c, g or t
accgatctcattataaacgcccgccacccgatcatctcgtaaatctcctcttctctccacttaaccccctattttaatcgcccaacgtctcccccccgccccccttcgccccttctcccccccctaccaactacctcgctaccttctacgcgcaccttcccactcgcccaaccctacccccctattcccctcctttcctccgctcccccccatacctccgccatcctatataacccgacgtcccgcgccgctatcgccacatattattcctactccgttaattaccacgtcgaaccaccgtcgtacacgccgctacccgactcaactcatcccgctcccactctctcgccttctaactctaaccgctcccgaaaatccactactcgccnccgccacctataaatttacccacgcccaccgctcgaaaacaataacttattactccgcactatcttcccctcaacccacacgtatccgtctcttaccccttcccgccccacctactct

SEQ ID NO: 40305 - DNA, 1236 bp, Artificial Sequence
  chemically treated genomic DNA (Homo sapiens) CpG-island No: 40305
atcgtcgaggggtggttttaatttcggttttcgcgtttttgttttgtcgtaggaataatagtttttttggaggcggcgtcggtcgcggtcgggggcggagttgtcggcgcgggagttgggggtgtgcgcggggcggggtcgtagttatttttttcgtcggcggtttcgttacgcgttttttatcgggcgggtcggggtttttgtgacgcggtggtaacggttacggatataaagggaaggcgaggaggcgagtaagaggttgggtttgttttcggttcgcgattttcgttcgtcgcgcgcgcgttcgttcgtttttttcgtcgcggtgttttttacgtcggttcgtattttcgcgcgtatttttgcgcgttcgcgattttcgtacgcgttcggattcgtcgatttcgtttcgagcgtcgcgggttcgggtttggcggacgttgcgggtggggcggggatgttgacgggttgttttttcgtttagcggcgcggttgttaggaggtatcgaggtagcggcggggttttgggcgcgcggttggatgttttcggtttgcggttttttgcgtttttcgtcgtttaggggtattagttatgggcgtcgtagtcgttgaggcgtcgtttcggttgtttgtcgcgttttcgttcgttttttgttgttatacgtcggtgtttttgtttttcgttttttttttgttcgggagtcgcgcgtttaattagttttcgggtggtggcggcggtagcggcggggattgtttcggcggtaaaggtaagagtattaattgtttaggtaggatcggtcggagtcggttttaggtttttttattttttcgttgtcgtttttttcgtggtttttgcggtcggtcgggttgggaaagatttcgtcgtgggggttttaggggtgggttcgagggtgagcgagggcggagggtagggcgcgagcgtgcggtgtggttttgggatcggcgttggggatgggagtggtcgtgggtgcgttcgagtgtgtcgagtggttgggcgagggcggttcggcgtgtggggaggcggtggggtcggggtcggggtcggcgaggttgagcggtcggtcggggttttcggtgtggtcgtgggtgtgttcgcgggagcgtgtgtttgtgttgtgaaggttgaggggagggagggcggttttaggtagggatttgtgtgtgtgtgtgtagagtgcggtgggtgggagacggcgagggggttgggcggggtga

SEQ ID NO: 40306 - DNA, 1236 bp, Artificial Sequence
  chemically treated genomic DNA (Homo sapiens) CpG-island No: 40306
tcaccccgcccaaccccctcgccgtctcccacccaccgcactctacacacacacacacaaatccctacctaaaaccgccctccctcccctcaaccttcacaacacaaacacacgctcccgcgaacacacccacgaccacaccgaaaaccccgaccgaccgctcaacctcgccgaccccgaccccgaccccaccgcctccccacacgccgaaccgccctcgcccaaccactcgacacactcgaacgcacccacgaccactcccatccccaacgccgatcccaaaaccacaccgcacgctcgcgccctaccctccgccctcgctcaccctcgaacccacccctaaaacccccacgacgaaatctttcccaacccgaccgaccgcaaaaaccacgaaaaaaacgacaacgaaaaaataaaaaaacctaaaaccgactccgaccgatcctacctaaacaattaatactcttacctttaccgccgaaacaatccccgccgctaccgccgccaccacccgaaaactaattaaacgcgcgactcccgaacaaaaaaaaaacgaaaaacaaaaacaccgacgtataacaacaaaaaacgaacgaaaacgcgacaaacaaccgaaacgacgcctcaacgactacgacgcccataactaatacccctaaacgacgaaaaacgcaaaaaaccgcaaaccgaaaacatccaaccgcgcgcccaaaaccccgccgctacctcgatacctcctaacaaccgcgccgctaaacgaaaaaacaacccgtcaacatccccgccccacccgcaacgtccgccaaacccgaacccgcgacgctcgaaacgaaatcgacgaatccgaacgcgtacgaaaatcgcgaacgcgcaaaaatacgcgcgaaaatacgaaccgacgtaaaaaacaccgcgacgaaaaaaacgaacgaacgcgcgcgcgacgaacgaaaatcgcgaaccgaaaacaaacccaacctcttactcgcctcctcgccttccctttatatccgtaaccgttaccaccgcgtcacaaaaaccccgacccgcccgataaaaaacgcgtaacgaaaccgccgacgaaaaaaataactacgaccccgccccgcgcacacccccaactcccgcgccgacaactccgcccccgaccgcgaccgacgccgcctccaaaaaaactattattcctacgacaaaacaaaaacgcgaaaaccgaaattaaaaccacccctcgacgat

SEQ ID NO: 40307 - DNA, 1236 bp, Artificial Sequence
  chemically treated genomic DNA (Homo sapiens) CpG-island No: 40307
ttatttcgtttagttttttcgtcgttttttatttatcgtattttgtatatatatatatagatttttgtttggggtcgttttttttttttttagtttttataatataaatatacgttttcgcgagtatatttacgattatatcgggagtttcggtcggtcgtttagtttcgtcggtttcggtttcggttttatcgtttttttatacgtcgggtcgttttcgtttagttattcgatatattcggacgtatttacggttatttttatttttagcgtcggttttaaagttatatcgtacgttcgcgttttgtttttcgttttcgtttattttcgggtttatttttgggatttttacgacggggttttttttagttcggtcgatcgtagggattacgagggaggcggtaacggaggggtgggaagatttagggtcggtttcgatcggttttatttgagtagttgatgtttttgtttttgtcgtcgggatagttttcgtcgttgtcgtcgttattattcgggggttggttggacgcgcggttttcgggtagagagaaggcgaagagtagaagtatcgacgtgtagtagtagaaggcgagcggaggcgcggtaggtagtcggagcggcgttttagcggttgcggcgtttatgattggtgtttttggacggcgggaagcgtagggagtcgtaggtcgggggtatttagtcgcgcgtttagagtttcgtcgttgtttcggtgttttttagtagtcgcgtcgttgagcggggaagtagttcgttagtattttcgttttattcgtagcgttcgttaggttcgggttcgcggcgttcgggacggagtcggcgggttcgggcgcgtgcgagggtcgcgggcgcgtaagggtgcgcgcgagggtgcgagtcggcgtgggggatatcgcggcgaggggagcgggcgggcgcgcgcgcggcgggcgggggtcgcgggtcggaggtaggtttagttttttgttcgttttttcgttttttttttgtgttcgtggtcgttgttatcgcgttataaagatttcggttcgttcggtgaggggcgcgtgacggagtcgtcggcgggaggggtggttgcgatttcgtttcgcgtatatttttagttttcgcgtcgatagtttcgttttcggtcgcggtcggcgtcgtttttaggggagttattgtttttgcgatagggtaggggcgcgggggtcggggttggggttatttttcggcggt

SEQ ID NO: 40308 - DNA, 1236 bp, Artificial Sequence
  chemically treated genomic DNA (Homo sapiens) CpG-island No: 40308
accgccgaaaaataaccccaaccccgacccccgcgcccctaccctatcgcaaaaacaataactcccctaaaaacgacgccgaccgcgaccgaaaacgaaactatcgacgcgaaaactaaaaatatacgcgaaacgaaatcgcaaccacccctcccgccgacgactccgtcacgcgcccctcaccgaacgaaccgaaatctttataacgcgataacaacgaccacgaacacaaaaaaaaaacgaaaaaacgaacaaaaaactaaacctacctccgacccgcgacccccgcccgccgcgcgcgcgcccgcccgctcccctcgccgcgatatcccccacgccgactcgcaccctcgcgcgcacccttacgcgcccgcgaccctcgcacgcgcccgaacccgccgactccgtcccgaacgccgcgaacccgaacctaacgaacgctacgaataaaacgaaaatactaacgaactacttccccgctcaacgacgcgactactaaaaaacaccgaaacaacgacgaaactctaaacgcgcgactaaatacccccgacctacgactccctacgcttcccgccgtccaaaaacaccaatcataaacgccgcaaccgctaaaacgccgctccgactacctaccgcgcctccgctcgccttctactactacacgtcgatacttctactcttcgccttctctctacccgaaaaccgcgcgtccaaccaacccccgaataataacgacgacaacgacgaaaactatcccgacgacaaaaacaaaaacatcaactactcaaataaaaccgatcgaaaccgaccctaaatcttcccacccctccgttaccgcctccctcgtaatccctacgatcgaccgaactaaaaaaaaccccgtcgtaaaaatcccaaaaataaacccgaaaataaacgaaaacgaaaaacaaaacgcgaacgtacgatataactttaaaaccgacgctaaaaataaaaataaccgtaaatacgtccgaatatatcgaataactaaacgaaaacgacccgacgtataaaaaaacgataaaaccgaaaccgaaaccgacgaaactaaacgaccgaccgaaactcccgatataatcgtaaatatactcgcgaaaacgtatatttatattataaaaactaaaaaaaaaaaaaacgaccccaaacaaaaatctatatatatatatacaaaatacgataaataaaaaacgacgaaaaaactaaacgaaataa

SEQ ID NO: 40309 - DNA, 566 bp, Artificial Sequence
  chemically treated genomic DNA (Homo sapiens) CpG-island No: 40309
tttttttttatttttattttttttttttatttttttttcgttcgttatcgtacgtgtattcggttttatttttatcgtttcgttatattatttgagtttttttttttcgattcgtatttttttttttttcgatcgtttttttattttcgttttatcgtttttcgattcgttcgtttttttattttcgtcgtttttgtttcgttttcgtcgttaatatttttttttttcgttttttattcgttttttttttttatttttttttttatgtatcgttttttttttttttattgttttatcggtcgtttttttattttgttttcgtcgcgttttttttttcgtttttttttatcgcgtcgttcgtttttcgtcgatcgtatatttcgcgatttttttttagtcgtttgtttattcgtttttaattttaattcggattttacgagtttttttattatcggtattttttttttttttttattatattttttcgtaaaaatttttttcgtttgttttcgaataattttttttttatcgcgtttttcgtcgttcgatttattcggatttttttt

SEQ ID NO: 40310 - DNA, 566 bp, Artificial Sequence
  chemically treated genomic DNA (Homo sapiens) CpG-island No: 40310
aaaaaaaatccgaataaatcgaacgacgaaaaacgcgataaaaaaaaaattattcgaaaacaaacgaaaaaaatttttacgaaaaaatataataaaaaaaaaaaaaaaataccgataataaaaaaactcgtaaaatccgaattaaaattaaaaacgaataaacaaacgactaaaaaaaaatcgcgaaatatacgatcgacgaaaaacgaacgacgcgataaaaaaaaacgaaaaaaaaaacgcgacgaaaacaaaataaaaaaacgaccgataaaacaataaaaaaaaaaaaaacgatacataaaaaaaaaaataaaaaaaaaaaacgaataaaaaacgaaaaaaaaaaatattaacgacgaaaacgaaacaaaaacgacgaaaataaaaaaacgaacgaatcgaaaaacgataaaacgaaaataaaaaaacgatcgaaaaaaaaaaaaatacgaatcgaaaaaaaaaaactcaaataatataacgaaacgataaaaataaaaccgaatacacgtacgataacgaacgaaaaaaaaataaaaaaaaaaaataaaaataaaaaaaaa

SEQ ID NO: 40311 - DNA, 566 bp, Artificial Sequence
  chemically treated genomic DNA (Homo sapiens) CpG-island No: 40311
agggagagttcgggtggatcgaacgacgagggacgcggtgggaaaaagattgttcgggagtagacgggggaggtttttgcggggaaatatagtgaaggggggaaaggggtatcggtgatgagggggttcgtagggttcgggttgaagttaggggcgggtaaataaacggttagaggggggtcgcggaatgtgcggtcggcggggggcggacgacgcgataagggggggcgagagggggaacgcggcgggaatagggtggggagacggtcggtgaaatagtaggaagagggagaacggtgtatgagagagggggtggggaaaaaaggcgggtgaagggcggagggaaggagtgttgacgacgagggcggagtaggggcggcggggataggagagcgagcgagtcggggaacgatgaagcgggggtgggagggcggtcgaggggggagagggtgcggatcgggggagaagagtttaagtggtgtagcgggacggtgaaggtgaggtcgagtatacgtacggtagcgagcgagggaaaggtggggggggaagatgggggtggaaaggga

SEQ ID NO: 40312 - DNA, 566 bp, Artificial Sequence
  chemically treated genomic DNA (Homo sapiens) CpG-island No: 40312
tccctttccacccccatcttccccccccacctttccctcgctcgctaccgtacgtatactcgacctcaccttcaccgtcccgctacaccacttaaactcttctcccccgatccgcaccctctcccccctcgaccgccctcccacccccgcttcatcgttccccgactcgctcgctctcctatccccgccgcccctactccgccctcgtcgtcaacactccttccctccgcccttcacccgccttttttccccaccccctctctcatacaccgttctccctcttcctactatttcaccgaccgtctccccaccctattcccgccgcgttccccctctcgcccccccttatcgcgtcgtccgccccccgccgaccgcacattccgcgacccccctctaaccgtttatttacccgcccctaacttcaacccgaaccctacgaaccccctcatcaccgatacccctttccccccttcactatatttccccgcaaaaacctcccccgtctactcccgaacaatctttttcccaccgcgtccctcgtcgttcgatccacccgaactctccct

SEQ ID NO: 40313 - DNA, 987 bp, Artificial Sequence
  chemically treated genomic DNA (Homo sapiens) CpG-island No: 40313
ttgtcgtttacgttgggtttcggtttttttaattgcgcgtttatatcgtgacgtcgatttcgttattaggggtgtcgtgaatgaggcgagtattataaggcggggtttcggttttattaggcggggcgggtagtattacggcgtttttcgggggcgggggagatgaggcggagtcggggttttttcgttgcggcgttattggtcgcgttcgtcgttattcggtagtagttgcggaggttagtttcgtttattttttttttttttcggagcgggcggcggcgttggcggtttgtgtagtaatggtgagagttgcggaatcgggcgttattcgagcgttgtgaggcgcgggggttggggaaggcggtgcgggttgagttcgcggattttatttgttatttaggtttgtggggcgtcgcgtagaatggtttggcgttattataattcgttttttcgtttggcgtcgggagaggcgcgcggttcgggtttgggttattttgtttaaggtacggtcggcgagggagattgttttgagttttggttggggtttcggcgtattcgtagtcgatggcgagtcgcgcgtttttgggggttggttacgtaggtgaaggggatatggtttcgcggtttggttgaggtatatttttttttgcgcgtaggttaagattaaggttcgagattttcgcgggaagaagaaggaggagttgttgaaatagttggacgatttgaaggtggagttgttttagttgcgcgtcgttaaagtgataggcggtgcggtttttaagttttttaagatgtaagtgaggcggtcggattatagttttcgtgggtggggagtacgtgtgtatcgggatcgtcggaggattttaaagttggtttaaggagttggtcgtttagatgtttatttcgtgtattttggcgcgtatgggagattcgttgtgtgtttagttttttatttgttttgattttgcggtttttgtgtttggaatg

SEQ ID NO: 40314 - DNA, 987 bp, Artificial Sequence
  chemically treated genomic DNA (Homo sapiens) CpG-island No: 40314
cattccaaacacaaaaaccgcaaaatcaaaacaaataaaaaactaaacacacaacgaatctcccatacgcgccaaaatacacgaaataaacatctaaacgaccaactccttaaaccaactttaaaatcctccgacgatcccgatacacacgtactccccacccacgaaaactataatccgaccgcctcacttacatcttaaaaaacttaaaaaccgcaccgcctatcactttaacgacgcgcaactaaaacaactccaccttcaaatcgtccaactatttcaacaactcctccttcttcttcccgcgaaaatctcgaaccttaatcttaacctacgcgcaaaaaaaaatatacctcaaccaaaccgcgaaaccatatccccttcacctacgtaaccaacccccaaaaacgcgcgactcgccatcgactacgaatacgccgaaaccccaaccaaaactcaaaacaatctccctcgccgaccgtaccttaaacaaaataacccaaacccgaaccgcgcgcctctcccgacgccaaacgaaaaaacgaattataataacgccaaaccattctacgcgacgccccacaaacctaaataacaaataaaatccgcgaactcaacccgcaccgccttccccaacccccgcgcctcacaacgctcgaataacgcccgattccgcaactctcaccattactacacaaaccgccaacgccgccgcccgctccgaaaaaaaaaaaaaataaacgaaactaacctccgcaactactaccgaataacgacgaacgcgaccaataacgccgcaacgaaaaaaccccgactccgcctcatctcccccgcccccgaaaaacgccgtaatactacccgccccgcctaataaaaccgaaaccccgccttataatactcgcctcattcacgacacccctaataacgaaatcgacgtcacgatataaacgcgcaattaaaaaaaccgaaacccaacgtaaacgacaa

SEQ ID NO: 40315 - DNA, 987 bp, Artificial Sequence
  chemically treated genomic DNA (Homo sapiens) CpG-island No: 40315
tattttaggtataaggatcgtaaggttaaggtaggtaagaggttaagtatataacgggttttttatgcgcgttaggatgtacggagtgggtatttaagcggttagttttttaagttaattttgaaatttttcgacgatttcgatgtatacgtgttttttatttacgagggttgtgattcggtcgttttatttatattttagagagtttggaggtcgtatcgtttgttattttggcgacgcgtagttgggatagttttatttttaggtcgtttagttgttttagtagtttttttttttttttttcgcgaagatttcgagttttgattttggtttgcgcgtaagagagagtgtgttttagttaggtcgcggggttatattttttttatttgcgtggttagtttttaaaggcgcgcgattcgttatcgattacgagtgcgtcggagttttaattagggtttaggatagtttttttcgtcggtcgtgttttgggtagagtaatttaggttcgggtcgcgcgtttttttcggcgttaagcgaagaggcgggttgtggtggcgttagattattttgcgcggcgttttataggtttaggtggtagatagaattcgcgggtttagttcgtatcgttttttttaattttcgcgttttatagcgttcggatggcgttcgatttcgtagtttttattattgttgtataagtcgttaacgtcgtcgttcgtttcgagggaaagaggaagtaggcggggttgattttcgtaattattgtcgggtggcggcgggcgcggttaatggcgtcgtagcgggggagtttcggtttcgttttatttttttcgttttcgaggaacgtcgtggtattgttcgtttcgtttggtagggtcggagtttcgttttgtagtgttcgttttatttacggtatttttgatagcgaggtcggcgttacggtgtaggcgcgtagttggggaaatcgaggtttaacgtgggcggtag

SEQ ID NO: 40316 - DNA, 987 bp, Artificial Sequence
  chemically treated genomic DNA (Homo sapiens) CpG-island No: 40316
ctaccgcccacgttaaacctcgatttccccaactacgcgcctacaccgtaacgccgacctcgctatcaaaaataccgtaaataaaacgaacactacaaaacgaaactccgaccctaccaaacgaaacgaacaataccacgacgttcctcgaaaacgaaaaaaataaaacgaaaccgaaactcccccgctacgacgccattaaccgcgcccgccgccacccgacaataattacgaaaatcaaccccgcctacttcctctttccctcgaaacgaacgacgacgttaacgacttatacaacaataataaaaactacgaaatcgaacgccatccgaacgctataaaacgcgaaaattaaaaaaaacgatacgaactaaacccgcgaattctatctaccacctaaacctataaaacgccgcgcaaaataatctaacgccaccacaacccgcctcttcgcttaacgccgaaaaaaacgcgcgacccgaacctaaattactctacccaaaacacgaccgacgaaaaaaactatcctaaaccctaattaaaactccgacgcactcgtaatcgataacgaatcgcgcgcctttaaaaactaaccacgcaaataaaaaaaatataaccccgcgacctaactaaaacacactctctcttacgcgcaaaccaaaatcaaaactcgaaatcttcgcgaaaaaaaaaaaaaaaaactactaaaacaactaaacgacctaaaaataaaactatcccaactacgcgtcgccaaaataacaaacgatacgacctccaaactctctaaaatataaataaaacgaccgaatcacaaccctcgtaaataaaaaacacgtatacatcgaaatcgtcgaaaaatttcaaaattaacttaaaaaactaaccgcttaaatacccactccgtacatcctaacgcgcataaaaaacccgttatatacttaacctcttacctaccttaaccttacgatccttatacctaaaata

SEQ ID NO: 40317 - DNA, 766 bp, Artificial Sequence
  chemically treated genomic DNA (Homo sapiens) CpG-island No: 40317
ttttcggcgtcgttttttcgttttcggagtcgcggttgaggagtttcgcgtttattggcggtcgcggttcggcgttttcgttttttttacgttttcgtttttttcgtcgtcgtcgtcgtttttcggtttcgtttttttttttttcgggagtcgttttcgtcgtcgttatcgttgttgtcggtcggggtttagttagcgtttgtcgcgtcggagtcgagtcgtagtcggagtcgttgttcgcggtttcgttatgagcggaagcgcggtcgtcgcggtcgttgtcgtcgtcgttttagtagtcgtcgtcgtcgcgtatttttagttttagtcgtcgttttttaggtcgggtttcgtcgagtttgggttttcgcgtcgttcgcgttttttatcgtcgtcgtttcggtcggagttcgtcgttacggatcgttttagtttttcgggttacgggttttttcgggcgggagtttagggtggcggcgtttgcggtcgagcgtcgggagtaggtacggggtttcggagcgggttaggtagggaggggcgtgggtcggtttcgcgggtgggggtcggaggcgtgtggtttaggcgttcggtttcgtcgacggggaggagcgttgttcgggttagttttgttcggtttcggagtttttgcgagttttgcgttttagtcgcgtcgagcgtttataaagcgtttttttattcggtgggtagtttttttttttagggtgtgtagggtaggatttttttaggtttttgttcggcggaggag

SEQ ID NO: 40318 - DNA, 766 bp, Artificial Sequence
  chemically treated genomic DNA (Homo sapiens) CpG-island No: 40318
ctcctccgccgaacaaaaacctaaaaaaatcctaccctacacaccctaaaaaaaaaaactacccaccgaataaaaaaacgctttataaacgctcgacgcgactaaaacgcaaaactcgcaaaaactccgaaaccgaacaaaactaacccgaacaacgctcctccccgtcgacgaaaccgaacgcctaaaccacacgcctccgacccccacccgcgaaaccgacccacgcccctccctacctaacccgctccgaaaccccgtacctactcccgacgctcgaccgcaaacgccgccaccctaaactcccgcccgaaaaaacccgtaacccgaaaaactaaaacgatccgtaacgacgaactccgaccgaaacgacgacgataaaaaacgcgaacgacgcgaaaacccaaactcgacgaaacccgacctaaaaaacgacgactaaaactaaaaatacgcgacgacgacgactactaaaacgacgacgacaacgaccgcgacgaccgcgcttccgctcataacgaaaccgcgaacaacgactccgactacgactcgactccgacgcgacaaacgctaactaaaccccgaccgacaacaacgataacgacgacgaaaacgactcccgaaaaaaaaaaaaacgaaaccgaaaaacgacgacgacgacgaaaaaaacgaaaacgtaaaaaaaacgaaaacgccgaaccgcgaccgccaataaacgcgaaactcctcaaccgcgactccgaaaacgaaaaaacgacgccgaaaa

SEQ ID NO: 40319 - DNA, 766 bp, Artificial Sequence
  chemically treated genomic DNA (Homo sapiens) CpG-island No: 40319
ttttttcgtcgagtagagatttagagaggttttgttttgtatattttgggggagggggttatttatcgggtgggaaaacgttttgtgagcgttcggcgcggttgaggcgtagggttcgtaggggtttcggggtcggataaagttgattcggataacgttttttttcgtcggcggggtcgggcgtttggattatacgttttcggtttttattcgcgggatcgatttacgtttttttttgtttggttcgtttcgggatttcgtatttgttttcggcgttcggtcgtaggcgtcgttattttgggttttcgttcggagaggttcgtggttcggagggttgaggcggttcgtggcggcgggtttcggtcggggcggcggcggtggggggcgcgggcggcgcgggggtttaagttcggcggggttcggtttgggagacgacgattgaggttgaaagtgcgcggcggcggcggttgttgaggcggcggcggtagcgatcgcggcggtcgcgttttcgtttatggcggggtcgcgagtagcggtttcggttgcgattcgatttcggcgcggtaggcgttggttgggtttcggtcggtagtagcggtggcggcgacggaggcggttttcgaagggggaggaggcggagtcgggaagcggcggcggcggcggagggggcggggacgtggagggggcggggacgtcgagtcgcggtcgttaatgggcgcggggttttttagtcgcggtttcgggggcgggagggcggcgtcgaggg

SEQ ID NO: 40320 - DNA, 766 bp, Artificial Sequence
  chemically treated genomic DNA (Homo sapiens) CpG-island No: 40320
ccctcgacgccgccctcccgcccccgaaaccgcgactaaaaaaccccgcgcccattaacgaccgcgactcgacgtccccgccccctccacgtccccgccccctccgccgccgccgccgcttcccgactccgcctcctcccccttcgaaaaccgcctccgtcgccgccaccgctactaccgaccgaaacccaaccaacgcctaccgcgccgaaatcgaatcgcaaccgaaaccgctactcgcgaccccgccataaacgaaaacgcgaccgccgcgatcgctaccgccgccgcctcaacaaccgccgccgccgcgcactttcaacctcaatcgtcgtctcccaaaccgaaccccgccgaacttaaacccccgcgccgcccgcgccccccaccgccgccgccccgaccgaaacccgccgccacgaaccgcctcaaccctccgaaccacgaacctctccgaacgaaaacccaaaataacgacgcctacgaccgaacgccgaaaacaaatacgaaatcccgaaacgaaccaaacaaaaaaaaacgtaaatcgatcccgcgaataaaaaccgaaaacgtataatccaaacgcccgaccccgccgacgaaaaaaaacgttatccgaatcaactttatccgaccccgaaacccctacgaaccctacgcctcaaccgcgccgaacgctcacaaaacgttttcccacccgataaataaccccctcccccaaaatatacaaaacaaaacctctctaaatctctactcgacgaaaaaa

SEQ ID NO: 40321 - DNA, 514 bp, Artificial Sequence
  chemically treated genomic DNA (Homo sapiens) CpG-island No: 40321
gtttttaggggattcggagtataagaatttaaatcgagatttttagttttagttttcgttttcgttcgtttttttttatatttaatcgttgggattagaagttttcggtagtttttttagtaagaggtatcgagtttgggcgtgatcgagttagtttcgtcgaggttttaggttataaatttatacgcgtttttttatttttttcgggttcgggtgtggtcgcggatcgttaatggcgcggagtttatttcgtaaagcgtttgtattatttttattagaatttattgtttcgtggcggtcgttatagttagtcgttttttttcggaaggcgggttataagcgcgttttaaaagtgcgcgtcgttgtttagtgtcgttattattttcgtagagggcggggcggcggagcgttgggtatcgtttattcgtatttgcgtattggttgataggaggttggacggggttaggtgggatgtcgtagtttttttaagaattgtttattttgtgttttatta

SEQ ID NO: 40322 - DNA, 514 bp, Artificial Sequence
  chemically treated genomic DNA (Homo sapiens) CpG-island No: 40322
taataaaacacaaaataaacaattcttaaaaaaactacgacatcccacctaaccccgtccaacctcctatcaaccaatacgcaaatacgaataaacgatacccaacgctccgccgccccgccctctacgaaaataataacgacactaaacaacgacgcgcacttttaaaacgcgcttataacccgccttccgaaaaaaaacgactaactataacgaccgccacgaaacaataaattctaataaaaataatacaaacgctttacgaaataaactccgcgccattaacgatccgcgaccacacccgaacccgaaaaaaataaaaaaacgcgtataaatttataacctaaaacctcgacgaaactaactcgatcacgcccaaactcgatacctcttactaaaaaaactaccgaaaacttctaatcccaacgattaaatataaaaaaaaacgaacgaaaacgaaaactaaaactaaaaatctcgatttaaattcttatactccgaatcccctaaaaac

SEQ ID NO: 40323 - DNA, 514 bp, Artificial Sequence
  chemically treated genomic DNA (Homo sapiens) CpG-island No: 40323
taataggatataaggtaaataatttttggaaaaattgcggtattttatttgatttcgtttagttttttgttaattagtgcgtaagtgcgagtaggcggtgtttagcgtttcgtcgtttcgttttttgcggaggtgataacgatattgagtagcgacgcgtatttttgggacgcgtttgtgattcgtttttcggaaggaagcggttaattatggcgatcgttacggagtagtgggttttggtggagatggtataggcgttttacgaggtgggtttcgcgttattagcggttcgcgattatattcgggttcggggagggtgggaggacgcgtgtggatttgtggtttgagatttcggcgggattggttcggttacgtttagattcggtgttttttgttggaaggattgtcgggagtttttagttttagcggttgagtgtagggaggaacgggcgggggcgggggttgggattgagggtttcggtttgaatttttatgtttcgggttttttggaagt

SEQ ID NO: 40324 - DNA, 514 bp, Artificial Sequence
  chemically treated genomic DNA (Homo sapiens) CpG-island No: 40324
acttccaaaaaacccgaaacataaaaattcaaaccgaaaccctcaatcccaacccccgcccccgcccgttcctccctacactcaaccgctaaaactaaaaactcccgacaatccttccaacaaaaaacaccgaatctaaacgtaaccgaaccaatcccgccgaaatctcaaaccacaaatccacacgcgtcctcccaccctccccgaacccgaatataatcgcgaaccgctaataacgcgaaacccacctcgtaaaacgcctataccatctccaccaaaacccactactccgtaacgatcgccataattaaccgcttccttccgaaaaacgaatcacaaacgcgtcccaaaaatacgcgtcgctactcaatatcgttatcacctccgcaaaaaacgaaacgacgaaacgctaaacaccgcctactcgcacttacgcactaattaacaaaaaactaaacgaaatcaaataaaataccgcaatttttccaaaaattatttaccttatatcctatta

SEQ ID NO: 40325 - DNA, 524 bp, Artificial Sequence
  chemically treated genomic DNA (Homo sapiens) CpG-island No: 40325
agtttgcgtttcgcggttcgcgtttttttcgttttcgttttagtattggagtagggtttaggttttttttcgttaggtggttttaaggtattaagcgggggcgggattttcgaggcgcgggaaaggcggaagcgttcggtagggaaggtgcgtgaaggcgggggattcgattttttttcggggtttttttttcgagggtcgaggttgcgagcgtttattaggtattcggcgtttaggtagtgtatcgtgcgttcgtcggcgggggtcggtgattgggagtcgtcgtcgttttttgtacgcggagacgtagcgttcgcgagtcggggtcggggtcggggttggggttggggttggggttggagtcggggtcgggtcggggaggggcgggtacggtgtagcgtcgtttttcgttcgtttttgcgtttggttcggcgattgcgggcgttgcggtttattgggttcgttttttttcggtatgggtttttgtttagtttattcgttgttagttggggttttgttttggt

SEQ ID NO: 40326 - DNA, 524 bp, Artificial Sequence
  chemically treated genomic DNA (Homo sapiens) CpG-island No: 40326
accaaaacaaaaccccaactaacaacgaataaactaaacaaaaacccataccgaaaaaaaacgaacccaataaaccgcaacgcccgcaatcgccgaaccaaacgcaaaaacgaacgaaaaacgacgctacaccgtacccgcccctccccgacccgaccccgactccaaccccaaccccaaccccaaccccgaccccgaccccgactcgcgaacgctacgtctccgcgtacaaaaaacgacgacgactcccaatcaccgacccccgccgacgaacgcacgatacactacctaaacgccgaatacctaataaacgctcgcaacctcgaccctcgaaaaaaaaaccccgaaaaaaaatcgaatcccccgccttcacgcaccttccctaccgaacgcttccgcctttcccgcgcctcgaaaatcccgcccccgcttaataccttaaaaccacctaacgaaaaaaaacctaaaccctactccaatactaaaacgaaaacgaaaaaaacgcgaaccgcgaaacgcaaact

SEQ ID NO: 40327 - DNA, 524 bp, Artificial Sequence
  chemically treated genomic DNA (Homo sapiens) CpG-island No: 40327
attagagtaggattttagttgatagcgggtgagttgggtagaaatttatgtcgggaagaggcggatttagtggatcgtagcgttcgtagtcgtcgggttaggcgtagaggcgaacgggaggcggcgttgtatcgtgttcgttttttttcggttcggtttcggttttagttttagttttagttttagtttcggtttcggtttcggttcgcgggcgttgcgttttcgcgtataggaggcggcggcggtttttagttatcggttttcgtcggcgagcgtacgatgtattgtttgggcgtcgagtatttggtaagcgttcgtagtttcggttttcgggggaggagtttcggggaagggtcgagtttttcgtttttacgtattttttttgtcggacgttttcgtttttttcgcgtttcggggatttcgttttcgtttagtattttggggttatttggcggggaggaatttggattttgttttagtgttggggcggaggcgggggagacgcgggtcgcggggcgtaaatt

SEQ ID NO: 40328 - DNA, 524 bp, Artificial Sequence
  chemically treated genomic DNA (Homo sapiens) CpG-island No: 40328
aatttacgccccgcgacccgcgtctcccccgcctccgccccaacactaaaacaaaatccaaattcctccccgccaaataaccccaaaatactaaacgaaaacgaaatccccgaaacgcgaaaaaaacgaaaacgtccgacaaaaaaaatacgtaaaaacgaaaaactcgacccttccccgaaactcctcccccgaaaaccgaaactacgaacgcttaccaaatactcgacgcccaaacaatacatcgtacgctcgccgacgaaaaccgataactaaaaaccgccgccgcctcctatacgcgaaaacgcaacgcccgcgaaccgaaaccgaaaccgaaactaaaactaaaactaaaactaaaaccgaaaccgaaccgaaaaaaaacgaacacgatacaacgccgcctcccgttcgcctctacgcctaacccgacgactacgaacgctacgatccactaaatccgcctcttcccgacataaatttctacccaactcacccgctatcaactaaaatcctactctaat

SEQ ID NO: 40329 - DNA, 642 bp, Artificial Sequence
  chemically treated genomic DNA (Homo sapiens) CpG-island No: 40329
tttcgttttttttttttttttttttttttttttttttttttattttgatttgggagatttttattcgcggtgcgaagtttcggattcgttgggaatcggatagttttcggtatttttggtcgtatgtttgtaagaggtgggtttcgggaaatatattcgttgattttgtaataagcggatttagtttcgattggaatcgtttttcgtatttttttttatatttatattgtttaaagttcgcggggcgggtttaatttacgtttacggtatttatgtggtcgtacgtggtacgttttatatttatagcgatcgttttcgtatggattgtttttttttcgtttttttttatcgtattatgtcggggcggaagtttattttttagggaacgtagcgagttgatagtttaattgggtcgcgaggcggtagagggcgagtgcggcgcgtagggtttattttatatttataggcgtgttagcgagatcggtgtaatttgatacgttttttattatttttttcgttattttagatataagttttcgttttcgcgaggcgtgtattgattttcggcgtttagcggttcgtcgcgtaaacgggagttatcggtttcgtgttacgggggcgttttttttcgtttcgtaagtt

SEQ ID NO: 40330 - DNA, 642 bp, Artificial Sequence
  chemically treated genomic DNA (Homo sapiens) CpG-island No: 40330
aacttacgaaacgaaaaaaaacgcccccgtaacacgaaaccgataactcccgtttacgcgacgaaccgctaaacgccgaaaatcaatacacgcctcgcgaaaacgaaaacttatatctaaaataacgaaaaaaataataaaaaacgtatcaaattacaccgatctcgctaacacgcctataaatataaaataaaccctacgcgccgcactcgccctctaccgcctcgcgacccaattaaactatcaactcgctacgttccctaaaaaataaacttccgccccgacataatacgataaaaaaaaacgaaaaaaaaacaatccatacgaaaacgatcgctataaatataaaacgtaccacgtacgaccacataaataccgtaaacgtaaattaaacccgccccgcgaactttaaacaatataaatataaaaaaaaatacgaaaaacgattccaatcgaaactaaatccgcttattacaaaatcaacgaatatatttcccgaaacccacctcttacaaacatacgaccaaaaataccgaaaactatccgattcccaacgaatccgaaacttcgcaccgcgaataaaaatctcccaaatcaaaataaaaaaaaaaaaaaaaaaaaaaaaaaaaaaaaaaaacgaaa

SEQ ID NO: 40331 - DNA, 642 bp, Artificial Sequence
  chemically treated genomic DNA (Homo sapiens) CpG-island No: 40331
gatttgcgaggcgggggaggacgttttcgtgatacggggtcgatgattttcgtttacgcgacgagtcgttgagcgtcgagaattaatgtacgtttcgcggagacggaggtttatgtttgagatgacgagaggggtggtggaagacgtgttagattgtatcggtttcgttggtacgtttataagtgtgaagtgggttttgcgcgtcgtattcgttttttatcgtttcgcggtttaattggattgttagttcgttgcgttttttggaaaatgggttttcgtttcggtataatacgatggggaagaacgagagagaagtagtttatgcgggggcggtcgttgtaggtgtggagcgtgttacgtgcgattatataagtatcgtgggcgtgggttgaattcgtttcgcgggttttggataatgtgggtgtagggggaggtgcgaaaaacggttttagtcggagttaggttcgtttgttgtagggttagcgagtgtgtttttcggggtttattttttataagtatgcggttaagggtgtcggagattattcggtttttagcggattcgaggtttcgtatcgcgagtaggaattttttaggttaaaataggagagagagagaaagagagagagagagaaggaggcgggg

SEQ ID NO: 40332 - DNA, 642 bp, Artificial Sequence
  chemically treated genomic DNA (Homo sapiens) CpG-island No: 40332
ccccgcctccttctctctctctctctttctctctctctcctattttaacctaaaaaattcctactcgcgatacgaaacctcgaatccgctaaaaaccgaataatctccgacacccttaaccgcatacttataaaaaataaaccccgaaaaacacactcgctaaccctacaacaaacgaacctaactccgactaaaaccgtttttcgcacctccccctacacccacattatccaaaacccgcgaaacgaattcaacccacgcccacgatacttatataatcgcacgtaacacgctccacacctacaacgaccgcccccgcataaactacttctctctcgttcttccccatcgtattataccgaaacgaaaacccattttccaaaaaacgcaacgaactaacaatccaattaaaccgcgaaacgataaaaaacgaatacgacgcgcaaaacccacttcacacttataaacgtaccaacgaaaccgatacaatctaacacgtcttccaccacccctctcgtcatctcaaacataaacctccgtctccgcgaaacgtacattaattctcgacgctcaacgactcgtcgcgtaaacgaaaatcatcgaccccgtatcacgaaaacgtcctcccccgcctcgcaaatc

SEQ ID NO: 40333 - DNA, 926 bp, Artificial Sequence
  chemically treated genomic DNA (Homo sapiens) CpG-island No: 40333
gagagagggttgagttttgtgcgttttcgttcgttgcgcgcgtcgttttaggtttcgtcgcgtttcgtttgcgttcgggattgcgtcgtagtatttattgtttcgtttatttgtttttggagtaggcgggtcgcgttagaagcgggcgatttcgtagtgttttgtagtcgcggacgtcgtttggttaggatgatattacgttgagcgcgtttgtaaataataataataataagcgtcgtcgcggttatcgcgttttgttttttcgaagcgtcgtcgtcgtcggtggagtcgttttcgcgtttttggtcgttcggagcgttcggtcgttggtgtatgtcgcgtttgttcgggacgggttgaagtcggcggcggggtcggatcgtaggcgtcgagtagggcgagggcggttagggtagtcgtttgtcgttaagtttcgagcgtcgttgttcgaggaaacgttttcggtcgggagttgcggtcgtcgttagtagtttttatgtttgggatttaggagaatatttcgcgcggggggacgattatgaaggaggagtcgttgggtagcggtatgaattcggtgcgttcgtggatgtatacggcgggcgtggtggacgttaatacggtcgtttagaggtacgtatcggtcgttttcgcgcgttttggtttcggtttcggttcggttcggtttttttcgtcggtcggcgtcgcgttttttatcgggtcgttgttttttttttttcgtagcggcgtggggttggcgcgggcgtatttcgagaagtagtcgttttttaattttcggaaatttaattttttttatttcgtgttggcgttttacgataggtaggggtagtcggtggagattgaaaggatcgtttttgtggattttgtggagaaagagaaagtaagtgtaaatatacgattatattttt

SEQ ID NO: 40334 - DNA, 926 bp, Artificial Sequence
  chemically treated genomic DNA (Homo sapiens) CpG-island No: 40334
aaaaatataatcgtatatttacacttactttctctttctccacaaaatccacaaaaacgatcctttcaatctccaccgactacccctacctatcgtaaaacgccaacacgaaataaaaaaaattaaatttccgaaaattaaaaaacgactacttctcgaaatacgcccgcgccaaccccacgccgctacgaaaaaaaaaaaacaacgacccgataaaaaacgcgacgccgaccgacgaaaaaaaccgaaccgaaccgaaaccgaaaccaaaacgcgcgaaaacgaccgatacgtacctctaaacgaccgtattaacgtccaccacgcccgccgtatacatccacgaacgcaccgaattcataccgctacccaacgactcctccttcataatcgtccccccgcgcgaaatattctcctaaatcccaaacataaaaactactaacgacgaccgcaactcccgaccgaaaacgtttcctcgaacaacgacgctcgaaacttaacgacaaacgactaccctaaccgccctcgccctactcgacgcctacgatccgaccccgccgccgacttcaacccgtcccgaacaaacgcgacatacaccaacgaccgaacgctccgaacgaccaaaaacgcgaaaacgactccaccgacgacgacgacgcttcgaaaaaacaaaacgcgataaccgcgacgacgcttattattattattatttacaaacgcgctcaacgtaatatcatcctaaccaaacgacgtccgcgactacaaaacactacgaaatcgcccgcttctaacgcgacccgcctactccaaaaacaaataaacgaaacaataaatactacgacgcaatcccgaacgcaaacgaaacgcgacgaaacctaaaacgacgcgcgcaacgaacgaaaacgcacaaaactcaaccctctctc

SEQ ID NO: 40335 - DNA, 926 bp, Artificial Sequence
  chemically treated genomic DNA (Homo sapiens) CpG-island No: 40335
gagggtgtgatcgtgtgtttgtatttattttttttttttttataaagtttataaaagcggtttttttaatttttatcggttgtttttgtttatcgtagagcgttagtacgaagtggaagaaattggattttcggaggttggaaggcggttgtttttcgaagtgcgttcgcgttagttttacgtcgttgcgggaggaaagagatagcggttcggtgaggagcgcggcgtcggtcggcggagggggtcgggtcgggtcggggtcggggttagggcgcgcgggggcggtcggtacgtatttttgggcggtcgtgttggcgtttattacgttcgtcgtgtgtatttacgagcgtatcgggtttatgtcgttgtttagcggttttttttttatggtcgttttttcgcgcggaatatttttttgaattttaaatatgaaaattgttggcggcggtcgtagttttcggtcgaaagcgttttttcgagtagcggcgttcggggtttggcggtaggcggttgttttggtcgttttcgttttgttcggcgtttgcggttcggtttcgtcgtcggttttagttcgtttcgggtaggcgcgatatatattagcggtcgggcgtttcggacggttaggggcgcggaggcggttttatcggcggcggcggcgtttcgaaggagtaggacgcggtggtcgcggcggcgtttgttgttgttgttgtttgtaggcgcgtttaacgtggtgttattttagttaggcggcgttcgcggttgtaggatattgcgggatcgttcgtttttggcgcggttcgtttgttttaaagataaataaacggggtagtgagtgttgcggcgtagtttcgggcgtaggcggggcgcggcggggtttggagcggcgcgcgtagcggacggaggcgtataaaatttagttttttttt

SEQ ID NO: 40336 - DNA, 926 bp, Artificial Sequence
  chemically treated genomic DNA (Homo sapiens) CpG-island No: 40336
aaaaaaaaactaaattttatacgcctccgtccgctacgcgcgccgctccaaaccccgccgcgccccgcctacgcccgaaactacgccgcaacactcactaccccgtttatttatctttaaaacaaacgaaccgcgccaaaaacgaacgatcccgcaatatcctacaaccgcgaacgccgcctaactaaaataacaccacgttaaacgcgcctacaaacaacaacaacaacaaacgccgccgcgaccaccgcgtcctactccttcgaaacgccgccgccgccgataaaaccgcctccgcgcccctaaccgtccgaaacgcccgaccgctaatatatatcgcgcctacccgaaacgaactaaaaccgacgacgaaaccgaaccgcaaacgccgaacaaaacgaaaacgaccaaaacaaccgcctaccgccaaaccccgaacgccgctactcgaaaaaacgctttcgaccgaaaactacgaccgccgccaacaattttcatatttaaaattcaaaaaaatattccgcgcgaaaaaacgaccataaaaaaaaaaccgctaaacaacgacataaacccgatacgctcgtaaatacacacgacgaacgtaataaacgccaacacgaccgcccaaaaatacgtaccgaccgcccccgcgcgccctaaccccgaccccgacccgacccgaccccctccgccgaccgacgccgcgctcctcaccgaaccgctatctctttcctcccgcaacgacgtaaaactaacgcgaacgcacttcgaaaaacaaccgccttccaacctccgaaaatccaatttcttccacttcgtactaacgctctacgataaacaaaaacaaccgataaaaattaaaaaaaccgcttttataaactttataaaaaaaaaaaaaataaatacaaacacacgatcacaccctc

SEQ ID NO: 40337 - DNA, 550 bp, Artificial Sequence
  chemically treated genomic DNA (Homo sapiens) CpG-island No: 40337
cggggtacggtggtaggcgggtcgttgggtcgtttacgggtatttttacgcgttttcgttcggttttagttcgtcgttcgcggtggaaggtagtgtggcgcgtgcgtattggcgtgttcgcggtcgggttcgtgggttttttcgggagggcgggaggtgggaacgtgggaaggcgcggggtcgtttatttttcggttcgtagtcggcgtcgtcgatatttcgcggtcggggcgttcgcgatgttcgtcgagtgagcggtataggtaagcgcgttttcgatttcgtcgggggtttttcgttttagttcgcggtttttaggcggtcgcggcgttagtaaagttgaatttcgcgcgtggcgggtcggatattgaacgttgggggtcgggttgtcggggtttcggagtcgggtgcgtttttttcgtttacgggagcgcgggcggggttgcggcggaggcgcggggtgggattgtggaggtaggagtttttgattatgagttgcgtttaggtttggtttcgtagtgaatttttgcgtcgcgttttggtagcgttt

SEQ ID NO: 40338 - DNA, 550 bp, Artificial Sequence
  chemically treated genomic DNA (Homo sapiens) CpG-island No: 40338
aaacgctaccaaaacgcgacgcaaaaattcactacgaaaccaaacctaaacgcaactcataatcaaaaactcctacctccacaatcccaccccgcgcctccgccgcaaccccgcccgcgctcccgtaaacgaaaaaaacgcacccgactccgaaaccccgacaacccgacccccaacgttcaatatccgacccgccacgcgcgaaattcaactttactaacgccgcgaccgcctaaaaaccgcgaactaaaacgaaaaacccccgacgaaatcgaaaacgcgcttacctataccgctcactcgacgaacatcgcgaacgccccgaccgcgaaatatcgacgacgccgactacgaaccgaaaaataaacgaccccgcgccttcccacgttcccacctcccgccctcccgaaaaaacccacgaacccgaccgcgaacacgccaatacgcacgcgccacactaccttccaccgcgaacgacgaactaaaaccgaacgaaaacgcgtaaaaatacccgtaaacgacccaacgacccgcctaccaccgtaccccg

SEQ ID NO: 40339 - DNA, 550 bp, Artificial Sequence
  chemically treated genomic DNA (Homo sapiens) CpG-island No: 40339
agacgttgttagggcgcggcgtaaaagtttattgcgaggttaggtttgggcgtagtttatggttaggggtttttgtttttatagttttatttcgcgttttcgtcgtagtttcgttcgcgttttcgtaggcgagaggagcgtattcggtttcggggtttcggtaattcggtttttagcgtttagtgttcggttcgttacgcgcgaagtttaattttgttggcgtcgcggtcgtttgggggtcgcgggttggggcggggagttttcgacgggatcgagagcgcgtttatttgtgtcgtttattcgacggatatcgcgggcgtttcggtcgcgaggtgtcggcggcgtcggttgcgggtcgggaggtgggcggtttcgcgtttttttacgtttttatttttcgttttttcgggagagtttacgggttcggtcgcgagtacgttagtgcgtacgcgttatattgttttttatcgcgggcggcgggttagggtcgagcgggggcgcgtggaggtgttcgtaggcggtttagcggttcgtttgttatcgtgtttcg

SEQ ID NO: 40340 - DNA, 550 bp, Artificial Sequence
  chemically treated genomic DNA (Homo sapiens) CpG-island No: 40340
cgaaacacgataacaaacgaaccgctaaaccgcctacgaacacctccacgcgcccccgctcgaccctaacccgccgcccgcgataaaaaacaatataacgcgtacgcactaacgtactcgcgaccgaacccgtaaactctcccgaaaaaacgaaaaataaaaacgtaaaaaaacgcgaaaccgcccacctcccgacccgcaaccgacgccgccgacacctcgcgaccgaaacgcccgcgatatccgtcgaataaacgacacaaataaacgcgctctcgatcccgtcgaaaactccccgccccaacccgcgacccccaaacgaccgcgacgccaacaaaattaaacttcgcgcgtaacgaaccgaacactaaacgctaaaaaccgaattaccgaaaccccgaaaccgaatacgctcctctcgcctacgaaaacgcgaacgaaactacgacgaaaacgcgaaataaaactataaaaacaaaaacccctaaccataaactacgcccaaacctaacctcgcaataaacttttacgccgcgccctaacaacgtct

SEQ ID NO: 40341 - DNA, 533 bp, Artificial Sequence
  chemically treated genomic DNA (Homo sapiens) CpG-island No: 40341
cgtagacgttttttgggcgggtcgcgtttttgggcgcggagtttcggttataggagttgggtcgcggggtttatagtttgttcgcgttcggttgttttttcgatttttagaaattaggtcgggaagtcgcgcgtcgcgcgtttattcgggttcggcggtttcgagggtcgggttatagcgttcgcggcgttcgtttggtttttggagtagttggttttagggcggtttggttatcgcgtaggtcgcgtagttagatattcggtttcgggtcgtcggagaggtcgggcgcgtttttcgtcggttcggagagatcggagttttttttgttattcgttgtgcgtaagaataggttaggggtcggggtttgtcgcggttatcgggggagagggagtatttggtagattttgttttcgacgtgattttttgttcggtattcggcggttttcgtcggggtaggaagtttggggtatttggcggggtttagatcgggatcggtcggttttgtagtagttttaggtttgtttagaaattag

SEQ ID NO: 40342 - DNA, 533 bp, Artificial Sequence
  chemically treated genomic DNA (Homo sapiens) CpG-island No: 40342
ctaatttctaaacaaacctaaaactactacaaaaccgaccgatcccgatctaaaccccgccaaataccccaaacttcctaccccgacgaaaaccgccgaataccgaacaaaaaatcacgtcgaaaacaaaatctaccaaatactccctctcccccgataaccgcgacaaaccccgacccctaacctattcttacgcacaacgaataacaaaaaaaactccgatctctccgaaccgacgaaaaacgcgcccgacctctccgacgacccgaaaccgaatatctaactacgcgacctacgcgataaccaaaccgccctaaaaccaactactccaaaaaccaaacgaacgccgcgaacgctataacccgaccctcgaaaccgccgaacccgaataaacgcgcgacgcgcgacttcccgacctaatttctaaaaatcgaaaaaacaaccgaacgcgaacaaactataaaccccgcgacccaactcctataaccgaaactccgcgcccaaaaacgcgacccgcccaaaaaacgtctacg

SEQ ID NO: 40343 - DNA, 533 bp, Artificial Sequence
  chemically treated genomic DNA (Homo sapiens) CpG-island No: 40343
ttgatttttaagtagatttaaggttgttgtagggtcggtcggtttcggtttgagtttcgttaggtattttaagttttttatttcggcggaggtcgtcgagtgtcgggtagggaattacgtcggaggtagggtttgttagatgttttttttttttcggtggtcgcggtagatttcggtttttggtttgtttttacgtatagcgagtgataaagaaggtttcggttttttcgggtcgacgggaagcgcgttcggttttttcggcgattcggagtcgggtgtttggttgcgcgatttgcgcggtggttagatcgttttggagttaattgttttaaaaattaagcggacgtcgcgggcgttgtggttcggttttcggagtcgtcggattcgggtgagcgcgcggcgcgcggtttttcgatttggtttttaggaatcgggagggtagtcgggcgcgggtagattgtgggtttcgcggtttagtttttgtagtcgggatttcgcgtttaggagcgcggttcgtttaaaggacgtttgcg

SEQ ID NO: 40344 - DNA, 533 bp, Artificial Sequence
  chemically treated genomic DNA (Homo sapiens) CpG-island No: 40344
cgcaaacgtcctttaaacgaaccgcgctcctaaacgcgaaatcccgactacaaaaactaaaccgcgaaacccacaatctacccgcgcccgactaccctcccgattcctaaaaaccaaatcgaaaaaccgcgcgccgcgcgctcacccgaatccgacgactccgaaaaccgaaccacaacgcccgcgacgtccgcttaatttttaaaacaattaactccaaaacgatctaaccaccgcgcaaatcgcgcaaccaaacacccgactccgaatcgccgaaaaaaccgaacgcgcttcccgtcgacccgaaaaaaccgaaaccttctttatcactcgctatacgtaaaaacaaaccaaaaaccgaaatctaccgcgaccaccgaaaaaaaaaaaacatctaacaaaccctacctccgacgtaattccctacccgacactcgacgacctccgccgaaataaaaaacttaaaatacctaacgaaactcaaaccgaaaccgaccgaccctacaacaaccttaaatctacttaaaaatcaa

SEQ ID NO: 40345 - DNA, 702 bp, Artificial Sequence
  chemically treated genomic DNA (Homo sapiens) CpG-island No: 40345
ttcggatacgaagaggggttaattttttttaagaacggggttttttcgcgggttaggaattgtgacggtcgtcgtttttttaggtcgagtgtagtagtttcgcgggtatacgcgtttaggaattagattcgggtcgtttcgtgtttatcgatttttcggaaacgaatcggatttcgcgcggttttatggattttttttttcggtttttgtttcggggtttcggcgagcgcggttttcgttagattgcggcgggtcgggttttttattcgcgcgtttttgttcgtcgaggtgtaatacgcgcggtcgcgtagcgagggttgtacgttgttcggacgtcggttgtcggcggagtgtttttattttattcgcggtggttttttggaggttgttattcggcggtgacgtgttttagtttacgttaggggagcgtagattagttgattattcgcggaagggtcggcgcgaaggaggcgcgagagtcggcgggcgggcgggcgggttagcgtcgggtcggttacgttttcgttcgtggcgggcgttggcgtcgcggtttcgtttatacgtaggtttcgtttatattttcggatttggggttcgcggtcgtagcgtttgcggtttagagcggggtttgtttttttatattagttcgtattgtttttttttgtagcgagcggggaaaggacgtagtgttgttgagtgttt

SEQ ID NO: 40346 - DNA, 702 bp, Artificial Sequence
  chemically treated genomic DNA (Homo sapiens) CpG-island No: 40346
aaacactcaacaacactacgtcctttccccgctcgctacaaaaaaaaacaatacgaactaatataaaaaaacaaaccccgctctaaaccgcaaacgctacgaccgcgaaccccaaatccgaaaatataaacgaaacctacgtataaacgaaaccgcgacgccaacgcccgccacgaacgaaaacgtaaccgacccgacgctaacccgcccgcccgcccgccgactctcgcgcctccttcgcgccgacccttccgcgaataatcaactaatctacgctcccctaacgtaaactaaaacacgtcaccgccgaataacaacctccaaaaaaccaccgcgaataaaataaaaacactccgccgacaaccgacgtccgaacaacgtacaaccctcgctacgcgaccgcgcgtattacacctcgacgaacaaaaacgcgcgaataaaaaacccgacccgccgcaatctaacgaaaaccgcgctcgccgaaaccccgaaacaaaaaccgaaaaaaaaaatccataaaaccgcgcgaaatccgattcgtttccgaaaaatcgataaacacgaaacgacccgaatctaattcctaaacgcgtatacccgcgaaactactacactcgacctaaaaaaacgacgaccgtcacaattcctaacccgcgaaaaaaccccgttcttaaaaaaaattaacccctcttcgtatccgaa

SEQ ID NO: 40347 - DNA, 702 bp, Artificial Sequence
  chemically treated genomic DNA (Homo sapiens) CpG-island No: 40347
agatatttagtagtattgcgtttttttttcgttcgttgtagggagaggtaatgcggattggtgtggaagggtaggtttcgttttgggtcgtaggcgttgcggtcgcgaattttaggttcgggagtgtgggcggggtttgcgtgtgggcggggtcgcggcgttagcgttcgttacgggcgagggcgtggtcgattcggcgttagttcgttcgttcgttcgtcggttttcgcgtttttttcgcgtcggttttttcgcgggtgattagttggtttgcgtttttttgacgtgggttggggtacgttatcgtcgaatggtagtttttagaaagttatcgcgagtaaggtgagggtatttcgtcggtagtcggcgttcgggtagcgtgtagttttcgttgcgcggtcgcgcgtgttgtatttcggcgggtagggacgcgcgggtgaggagttcggttcgtcgtagtttggcgagggtcgcgttcgtcggagtttcggaataggagtcgggggaaggggtttatgaggtcgcgcgagattcggttcgttttcggagggtcggtgggtacggggcggttcgagtttggtttttggacgcgtatgttcgcggaattgttgtattcggtttgagggggcgacggtcgttatagtttttggttcgcgggaaggtttcgtttttggaggaagttggttttttttcgtgttcggg

SEQ ID NO: 40348 - DNA, 702 bp, Artificial Sequence
  chemically treated genomic DNA (Homo sapiens) CpG-island No: 40348
cccgaacacgaaaaaaaaccaacttcctccaaaaacgaaaccttcccgcgaaccaaaaactataacgaccgtcgccccctcaaaccgaatacaacaattccgcgaacatacgcgtccaaaaaccaaactcgaaccgccccgtacccaccgaccctccgaaaacgaaccgaatctcgcgcgacctcataaaccccttcccccgactcctattccgaaactccgacgaacgcgaccctcgccaaactacgacgaaccgaactcctcacccgcgcgtccctacccgccgaaatacaacacgcgcgaccgcgcaacgaaaactacacgctacccgaacgccgactaccgacgaaataccctcaccttactcgcgataactttctaaaaactaccattcgacgataacgtaccccaacccacgtcaaaaaaacgcaaaccaactaatcacccgcgaaaaaaccgacgcgaaaaaaacgcgaaaaccgacgaacgaacgaacgaactaacgccgaatcgaccacgccctcgcccgtaacgaacgctaacgccgcgaccccgcccacacgcaaaccccgcccacactcccgaacctaaaattcgcgaccgcaacgcctacgacccaaaacgaaacctacccttccacaccaatccgcattacctctccctacaacgaacgaaaaaaaaacgcaatactactaaatatct

SEQ ID NO: 40349 - DNA, 759 bp, Artificial Sequence
  chemically treated genomic DNA (Homo sapiens) CpG-island No: 40349
cgttgtttgcgtttgggtttttttaatcgtagtgagcggtcgtacggttttatattagggtcgttttgaggtttagtttttttcggttttatttcgagtgcgtataggattgaacgagtacgttcggtttttgtttcggagcggaggatacgacgcggattcgtacggtgtatcgtagtgatttgaggaaggagcgacgggcgttcgcgttaaaggcgttcgagtgtttggtaaattgtaaagcgcggttttgcgtgagttgttatggttatagttgcgttaggcggacggtttgtaggatcgaggtgtagttgggacgagcggaaagttttgcgcgtgggcggggagttcggagtttcgtcggggtaatgttatttaggtgttcggcgttttattgattcggttttcgggggtgggcgggtacgtttgtttcggatggtttaataggcgtcggggagagttaatggtgtggttttatggttttatttttttttattcgattggtcggcgtcgaaaagtcgggcgtgagcggtcgtagtttttggagggagtcgttgcgggttttttttttattcgtttttcgcgcgtcgtcgtttttcggttttgttttgttcgtcgttatggtttagtgagtgattcgttaggggtagttcggttcggttttagcgggcggggaattttttgggggtcgagatttttttcgtttttttcgacgttttttattttgggggtcgtttgagtttatttggggttttgtga

SEQ ID NO: 40350 - DNA, 759 bp, Artificial Sequence
  chemically treated genomic DNA (Homo sapiens) CpG-island No: 40350
tcacaaaaccccaaataaactcaaacgacccccaaaataaaaaacgtcgaaaaaaacgaaaaaaatctcgacccccaaaaaattccccgcccgctaaaaccgaaccgaactacccctaacgaatcactcactaaaccataacgacgaacaaaacaaaaccgaaaaacgacgacgcgcgaaaaacgaataaaaaaaaaacccgcaacgactccctccaaaaactacgaccgctcacgcccgacttttcgacgccgaccaatcgaataaaaaaaaataaaaccataaaaccacaccattaactctccccgacgcctattaaaccatccgaaacaaacgtacccgcccacccccgaaaaccgaatcaataaaacgccgaacacctaaataacattaccccgacgaaactccgaactccccgcccacgcgcaaaactttccgctcgtcccaactacacctcgatcctacaaaccgtccgcctaacgcaactataaccataacaactcacgcaaaaccgcgctttacaatttaccaaacactcgaacgcctttaacgcgaacgcccgtcgctccttcctcaaatcactacgatacaccgtacgaatccgcgtcgtatcctccgctccgaaacaaaaaccgaacgtactcgttcaatcctatacgcactcgaaataaaaccgaaaaaaactaaacctcaaaacgaccctaatataaaaccgtacgaccgctcactacgattaaaaaaacccaaacgcaaacaacg

SEQ ID NO: 40351 - DNA, 759 bp, Artificial Sequence
  chemically treated genomic DNA (Homo sapiens) CpG-island No: 40351
ttatagagttttaagtgagtttaggcgatttttagggtgggaggcgtcggagagaacgagggagatttcgatttttaaagagtttttcgttcgttgaggtcgagtcgggttgtttttggcgagttatttattgggttatggcggcggatagagtagaatcgaagagcggcgacgcgcggaggacgagtgagggaaagattcgtagcggttttttttagaaattgcggtcgtttacgttcggtttttcggcgtcggttaatcgaatggaagggggtggagttatgaagttatattattggtttttttcgacgtttgttagattattcgaggtaaacgtgttcgtttattttcgggggtcggattagtggagcgtcgagtatttagatgatattgtttcggcgaggtttcgggtttttcgtttacgcgtagagtttttcgttcgttttagttgtatttcggttttgtaggtcgttcgtttggcgtagttgtagttatagtaatttacgtaggatcgcgttttatagtttattaggtattcggacgtttttggcgcgagcgttcgtcgttttttttttaggttattgcggtgtatcgtgcgggttcgcgtcgtgtttttcgtttcggagtagggatcgggcgtgttcgtttagttttgtgcgtattcggaatggggtcggggaaggttgagttttagggcgattttgatgtggagtcgtgcgatcgtttattgcggttgaagagatttaggcgtagatagcg

SEQ ID NO: 40352 - DNA, 759 bp, Artificial Sequence
  chemically treated genomic DNA (Homo sapiens) CpG-island No: 40352
cgctatctacgcctaaatctcttcaaccgcaataaacgatcgcacgactccacatcaaaatcgccctaaaactcaaccttccccgaccccattccgaatacgcacaaaactaaacgaacacgcccgatccctactccgaaacgaaaaacacgacgcgaacccgcacgatacaccgcaataacctaaaaaaaaaacgacgaacgctcgcgccaaaaacgtccgaatacctaataaactataaaacgcgatcctacgtaaattactataactacaactacgccaaacgaacgacctacaaaaccgaaatacaactaaaacgaacgaaaaactctacgcgtaaacgaaaaacccgaaacctcgccgaaacaatatcatctaaatactcgacgctccactaatccgacccccgaaaataaacgaacacgtttacctcgaataatctaacaaacgtcgaaaaaaaccaataatataacttcataactccacccccttccattcgattaaccgacgccgaaaaaccgaacgtaaacgaccgcaatttctaaaaaaaaccgctacgaatctttccctcactcgtcctccgcgcgtcgccgctcttcgattctactctatccgccgccataacccaataaataactcgccaaaaacaacccgactcgacctcaacgaacgaaaaactctttaaaaatcgaaatctccctcgttctctccgacgcctcccaccctaaaaatcgcctaaactcacttaaaactctataa

SEQ ID NO: 40353 - DNA, 547 bp, Artificial Sequence
  chemically treated genomic DNA (Homo sapiens) CpG-island No: 40353
taggaaaacgggggtcgggttgggttggggtaggacggcgtcgagtttttggatagaaaagtattcggtagttttcggcggttttttatcggtatttcgttttcgggcgtttttcgcggttgcgtatgcgttgtcgcgggtggtgttgggaggcggttttcgcggtaacgcggttggattttggtttgcgttggttggggaggaagcggttttaggggagcgtgcgggcgtcggggttcggcgacgagaggttattttttggttttgcgatgaattttcggttttttttttttagatggggttttcgtgagggtataacgtcggtattagatattttaggtgacgttcgtacgcggtgggcggttcgggtcggagttttggaacgttggttttggaggcgtcgatttttcgttattgatgtagggacgcggtgcggattagttaggtttagagttcgtttttagatgtgggttcgaatttttgtttcgttaatttgtgatcgtatcgattcggtttagacgtaatttttttttttgtaaaatcgtta

SEQ ID NO: 40354 - DNA, 547 bp, Artificial Sequence
  chemically treated genomic DNA (Homo sapiens) CpG-island No: 40354
taacgattttacaaaaaaaaaaattacgtctaaaccgaatcgatacgatcacaaattaacgaaacaaaaattcgaacccacatctaaaaacgaactctaaacctaactaatccgcaccgcgtccctacatcaataacgaaaaatcgacgcctccaaaaccaacgttccaaaactccgacccgaaccgcccaccgcgtacgaacgtcacctaaaatatctaataccgacgttataccctcacgaaaaccccatctaaaaaaaaaaaaccgaaaattcatcgcaaaaccaaaaaataacctctcgtcgccgaaccccgacgcccgcacgctcccctaaaaccgcttcctccccaaccaacgcaaaccaaaatccaaccgcgttaccgcgaaaaccgcctcccaacaccacccgcgacaacgcatacgcaaccgcgaaaaacgcccgaaaacgaaataccgataaaaaaccgccgaaaactaccgaatacttttctatccaaaaactcgacgccgtcctaccccaacccaacccgacccccgttttccta

SEQ ID NO: 40355 - DNA, 547 bp, Artificial Sequence
  chemically treated genomic DNA (Homo sapiens) CpG-island No: 40355
tgacgattttgtagagaagaaaattgcgtttgggtcgagtcgatacgattataagttggcggggtagagattcgaatttatatttaaggacgagttttgggtttgattggttcgtatcgcgtttttgtattagtaacgaggggtcgacgtttttagggttagcgttttagagtttcggttcgaatcgtttatcgcgtacgggcgttatttggaatgtttaatgtcgacgttgtatttttacgaaaattttatttgagaaggggaaatcgaggatttatcgtaaggttagaaggtggtttttcgtcgtcggatttcggcgttcgtacgtttttttagaatcgttttttttttagttagcgtaggttagggtttagtcgcgttgtcgcggaaatcgttttttagtattattcgcggtaacgtatgcgtagtcgcggggggcgttcgggggcggggtgtcgatgagaagtcgtcgggggttgtcgggtatttttttgtttagaaattcgacgtcgttttgttttagtttagttcgattttcgtttttttg

SEQ ID NO: 40356 - DNA, 547 bp, Artificial Sequence
  chemically treated genomic DNA (Homo sapiens) CpG-island No: 40356
caaaaaaacgaaaatcgaactaaactaaaacaaaacgacgtcgaatttctaaacaaaaaaatacccgacaacccccgacgacttctcatcgacaccccgcccccgaacgccccccgcgactacgcatacgttaccgcgaataatactaaaaaacgatttccgcgacaacgcgactaaaccctaacctacgctaactaaaaaaaaaacgattctaaaaaaacgtacgaacgccgaaatccgacgacgaaaaaccaccttctaaccttacgataaatcctcgatttccccttctcaaataaaattttcgtaaaaatacaacgtcgacattaaacattccaaataacgcccgtacgcgataaacgattcgaaccgaaactctaaaacgctaaccctaaaaacgtcgacccctcgttactaatacaaaaacgcgatacgaaccaatcaaacccaaaactcgtccttaaatataaattcgaatctctaccccgccaacttataatcgtatcgactcgacccaaacgcaattttcttctctacaaaatcgtca

SEQ ID NO: 40357 - DNA, 890 bp, Artificial Sequence
  chemically treated genomic DNA (Homo sapiens) CpG-island No: 40357
taggtatttttggaagcggtagaagggatagcgtttgcgttgcgttttgtcgattttgtagttttggttttcggtgtacgtgtagtgtttgttgttttgtatcgtgcgtttgaagaagttttgcgggagttgagagttagcgaggtttcgtagcgttcgtttgtcgtatttttgtcgcgcgttcgtcgtttattttgtagtttttatacgtgagtagttcgtagtggtagtcggatattttgttttcgtatacggggtatagttcgtttaggttttcgtcgtacgaatagtttatgttcgcggcgttcgtttgcggagggatagcgggttagggagggtcggcggagatcggtagtttggggttttcgcggtcgtcgttttagtcgttgtcgtcggttcgtcgcgtaattttttttttgtgtttaggcgttgtcgtcggtatttatcgagcgtttcgcgtagcgtttcggggtgggttcggtgtagttttcgcgttcggtttttttttgttaggttttacgttttcgtttcgttcggggggtttttttcgcgcggatttcgtcgcgttcgatttggggttttcgggttcgatgcgtttcgattgggattcgtttgtttgagaataaaatttcgattttgagaaaaagagatgggtttagtcgcggggaagacgttaggggatttaggagcgttggggcgttcggttcgggtgttttgggaattcgatagagacgaaggaggtagagatagagttcgggggagttagagatgggaagaaattttggcgagagataacgatcgacgttatcgggcgtagatacgaggttagttcgagagtgttagagatatagatattgagacgtttagttagagagaattcggcggggacg

SEQ ID NO: 40358 - DNA, 890 bp, Artificial Sequence
  chemically treated genomic DNA (Homo sapiens) CpG-island No: 40358
cgtccccgccgaattctctctaactaaacgtctcaatatctatatctctaacactctcgaactaacctcgtatctacgcccgataacgtcgatcgttatctctcgccaaaatttcttcccatctctaactcccccgaactctatctctacctccttcgtctctatcgaattcccaaaacacccgaaccgaacgccccaacgctcctaaatcccctaacgtcttccccgcgactaaacccatctctttttctcaaaatcgaaattttattctcaaacaaacgaatcccaatcgaaacgcatcgaacccgaaaaccccaaatcgaacgcgacgaaatccgcgcgaaaaaaaccccccgaacgaaacgaaaacgtaaaacctaacaaaaaaaaaccgaacgcgaaaactacaccgaacccaccccgaaacgctacgcgaaacgctcgataaataccgacgacaacgcctaaacacaaaaaaaaaattacgcgacgaaccgacgacaacgactaaaacgacgaccgcgaaaaccccaaactaccgatctccgccgaccctccctaacccgctatccctccgcaaacgaacgccgcgaacataaactattcgtacgacgaaaacctaaacgaactataccccgtatacgaaaacaaaatatccgactaccactacgaactactcacgtataaaaactacaaaataaacgacgaacgcgcgacaaaaatacgacaaacgaacgctacgaaacctcgctaactctcaactcccgcaaaacttcttcaaacgcacgatacaaaacaacaaacactacacgtacaccgaaaaccaaaactacaaaatcgacaaaacgcaacgcaaacgctatcccttctaccgcttccaaaaataccta

SEQ ID NO: 40359 - DNA, 890 bp, Artificial Sequence
  chemically treated genomic DNA (Homo sapiens) CpG-island No: 40359
cgttttcgtcgggttttttttagttgggcgttttagtgtttgtgtttttggtattttcggattggtttcgtgtttgcgttcggtggcgtcggtcgttgtttttcgttagagtttttttttatttttggttttttcggattttgtttttgtttttttcgtttttgtcgggtttttagaatattcgggtcgggcgttttagcgtttttgggttttttggcgtttttttcgcggttgagtttattttttttttttagaatcggggttttgtttttagataaacgaattttaatcgaagcgtatcgaattcgagggttttagatcgggcgcgacggggttcgcgcgggaggagtttttcggacggggcgggagcgtggggtttggtaggggaaggtcgggcgcggggattgtatcggatttatttcgggacgttgcgcggggcgttcggtgggtgtcggcggtagcgtttgggtatagagaggggattacgcgacgggtcggcgatagcggttggggcggcggtcgcggggattttaggttgtcggttttcgtcggttttttttgattcgttgttttttcgtaggcggacgtcgcgggtatggattattcgtacgacgaggatttggacgagttgtgtttcgtgtgcggggataaggtgttcggttattattacggattgtttacgtgtgagagttgtaaggtgagcggcgagcgcgcggtaggggtgcggtagacgggcgttgcggggtttcgttgatttttagttttcgtagggtttttttaagcgtacggtgtagaataataagtattatacgtgtatcgagagttagagttgtaagatcgataagacgtagcgtaagcgttgttttttttgtcgtttttagaaatgtttg

SEQ ID NO: 40360 - DNA, 890 bp, Artificial Sequence
  chemically treated genomic DNA (Homo sapiens) CpG-island No: 40360
caaacatttctaaaaacgacaaaaaaaacaacgcttacgctacgtcttatcgatcttacaactctaactctcgatacacgtataatacttattattctacaccgtacgcttaaaaaaaccctacgaaaactaaaaatcaacgaaaccccgcaacgcccgtctaccgcacccctaccgcgcgctcgccgctcaccttacaactctcacacgtaaacaatccgtaataataaccgaacaccttatccccgcacacgaaacacaactcgtccaaatcctcgtcgtacgaataatccatacccgcgacgtccgcctacgaaaaaacaacgaatcaaaaaaaaccgacgaaaaccgacaacctaaaatccccgcgaccgccgccccaaccgctatcgccgacccgtcgcgtaatcccctctctatacccaaacgctaccgccgacacccaccgaacgccccgcgcaacgtcccgaaataaatccgatacaatccccgcgcccgaccttcccctaccaaaccccacgctcccgccccgtccgaaaaactcctcccgcgcgaaccccgtcgcgcccgatctaaaaccctcgaattcgatacgcttcgattaaaattcgtttatctaaaaacaaaaccccgattctaaaaaaaaaaaataaactcaaccgcgaaaaaaacgccaaaaaacccaaaaacgctaaaacgcccgacccgaatattctaaaaacccgacaaaaacgaaaaaaacaaaaacaaaatccgaaaaaaccaaaaataaaaaaaaactctaacgaaaaacaacgaccgacgccaccgaacgcaaacacgaaaccaatccgaaaataccaaaaacacaaacactaaaacgcccaactaaaaaaaacccgacgaaaacg

SEQ ID NO: 40361 - DNA, 574 bp, Artificial Sequence
  chemically treated genomic DNA (Homo sapiens) CpG-island No: 40361
tttcgtcgtcggtttcgttattttcgtttcgtcgtggtcgaaattgatataaagtagcgggtcgaggtttcgggggagcggggtcgtagttgggggggcgggagttcgtggggagtcgagtcgagcgtttttcgttttagttttcggtatgggtagtacggggtcgtcggggcgggcgtcgagcgttgagcgttgaggtgaggcgaggcgaggcgaagcgggggcgttcgggagcgcggggttaggagggtagagggagatgcggtcgtagtcgcggggttggaggggtcggggagcgggtgtagattggggagtatcgggggttaagatttgggagttgcggttagacggggcggggatggcggtcgattggagacgaggggttgtcgggtgttcggggacggggtagagcgggggtttgcgtataggatgggaggatggggtgtcgaaggggcgcgtggagagtaggagagcggcgcgagtgttaaggagaagttcgtgtagttttggttaggggagattcgtttagagagttgttgggcgagaggagtaatcgggattcgagggtttggtg

SEQ ID NO: 40362 - DNA, 574 bp, Artificial Sequence
  chemically treated genomic DNA (Homo sapiens) CpG-island No: 40362
caccaaaccctcgaatcccgattactcctctcgcccaacaactctctaaacgaatctcccctaaccaaaactacacgaacttctccttaacactcgcgccgctctcctactctccacgcgccccttcgacaccccatcctcccatcctatacgcaaacccccgctctaccccgtccccgaacacccgacaacccctcgtctccaatcgaccgccatccccgccccgtctaaccgcaactcccaaatcttaacccccgatactccccaatctacacccgctccccgacccctccaaccccgcgactacgaccgcatctccctctaccctcctaaccccgcgctcccgaacgcccccgcttcgcctcgcctcgcctcacctcaacgctcaacgctcgacgcccgccccgacgaccccgtactacccataccgaaaactaaaacgaaaaacgctcgactcgactccccacgaactcccgcccccccaactacgaccccgctcccccgaaacctcgacccgctactttatatcaatttcgaccacgacgaaacgaaaataacgaaaccgacgacgaaa

SEQ ID NO: 40363 - DNA, 574 bp, Artificial Sequence
  chemically treated genomic DNA (Homo sapiens) CpG-island No: 40363
tattaaattttcgggtttcggttatttttttcgtttaataattttttgggcgggttttttttggttaaggttgtacgagtttttttttggtattcgcgtcgtttttttgttttttacgcgttttttcggtattttatttttttattttgtacgtagattttcgttttgtttcgttttcgggtattcgatagtttttcgtttttagtcggtcgttattttcgtttcgtttggtcgtagtttttaaattttggttttcggtgttttttagtttatattcgtttttcggtttttttagtttcgcggttgcggtcgtatttttttttgtttttttggtttcgcgttttcgggcgttttcgtttcgtttcgtttcgttttattttagcgtttagcgttcggcgttcgtttcggcggtttcgtattgtttatgtcgggggttggggcggggggcgttcggttcggttttttacgggttttcgtttttttagttgcggtttcgttttttcggggtttcggttcgttattttgtgttagtttcggttacggcggggcggaagtgacggagtcggcggcgggg

SEQ ID NO: 40364 - DNA, 574 bp, Artificial Sequence
  chemically treated genomic DNA (Homo sapiens) CpG-island No: 40364
ccccgccgccgactccgtcacttccgccccgccgtaaccgaaactaacacaaaataacgaaccgaaaccccgaaaaaacgaaaccgcaactaaaaaaacgaaaacccgtaaaaaaccgaaccgaacgccccccgccccaacccccgacataaacaatacgaaaccgccgaaacgaacgccgaacgctaaacgctaaaataaaacgaaacgaaacgaaacgaaaacgcccgaaaacgcgaaaccaaaaaaacaaaaaaaaatacgaccgcaaccgcgaaactaaaaaaaccgaaaaacgaatataaactaaaaaacaccgaaaaccaaaatttaaaaactacgaccaaacgaaacgaaaataacgaccgactaaaaacgaaaaactatcgaatacccgaaaacgaaacaaaacgaaaatctacgtacaaaataaaaaaataaaataccgaaaaaacgcgtaaaaaacaaaaaaacgacgcgaataccaaaaaaaaactcgtacaaccttaaccaaaaaaaacccgcccaaaaaattattaaacgaaaaaaataaccgaaacccgaaaatttaata

SEQ ID NO: 40365 - DNA, 707 bp, Artificial Sequence
  chemically treated genomic DNA (Homo sapiens) CpG-island No: 40365
gggcggggagcgcgggcgtcgacgtcggtttagtcggcggtttaagcgagagacgcggttttcggggttttttcgtattttttcgtatttttcggggttttcggtcgttatttcgtcgtcgtttgggcgttttgcggagagaagatgggaggtaaggattggatcgacgggtttttagttttagggcgttaggttcggggcgtaaattcgggagggaagtttcggtcgtttagtttagatcgtttggagatttttggcggttattttcggattttttcgggcggcgaggcggggattcgttcgcgttcgggttttttcgtagcggagttttaagttaggtacgcgcggtaaaagtcggagtttgttcggttaacggtcgaaaagaaggaaggggggcgtaaaatgttttttggcgtatttcgggttgtaaatttgtcgtttgcgttcggttcgtaagttcgcgggttttgggtttcgggaaacgtgcggtttttagttgtcgcgtttttagggtaagtatttttcgggttcgattttattttcgtacgtggttgtatcgtagtaaatggggcgggggcgttcgggttttttaggttcgtaggggtcgttcgtcgggttttattttttttttattgtgttttatatatcgtagcgcgggaggagggggcgttatcggttttagtttttttttgttcgttttttttttt

SEQ ID NO: 40366 - DNA, 707 bp, Artificial Sequence
  chemically treated genomic DNA (Homo sapiens) CpG-island No: 40366
aaaaaaaaaaacgaacaaaaaaaaactaaaaccgataacgccccctcctcccgcgctacgatatataaaacacaataaaaaaaaaataaaacccgacgaacgacccctacgaacctaaaaaacccgaacgcccccgccccatttactacgatacaaccacgtacgaaaataaaatcgaacccgaaaaatacttaccctaaaaacgcgacaactaaaaaccgcacgtttcccgaaacccaaaacccgcgaacttacgaaccgaacgcaaacgacaaatttacaacccgaaatacgccaaaaaacattttacgccccccttccttcttttcgaccgttaaccgaacaaactccgacttttaccgcgcgtacctaacttaaaactccgctacgaaaaaacccgaacgcgaacgaatccccgcctcgccgcccgaaaaaatccgaaaataaccgccaaaaatctccaaacgatctaaactaaacgaccgaaacttccctcccgaatttacgccccgaacctaacgccctaaaactaaaaacccgtcgatccaatccttacctcccatcttctctccgcaaaacgcccaaacgacgacgaaataacgaccgaaaaccccgaaaaatacgaaaaaatacgaaaaaaccccgaaaaccgcgtctctcgcttaaaccgccgactaaaccgacgtcgacgcccgcgctccccgccc

SEQ ID NO: 40367 - DNA, 707 bp, Artificial Sequence
  chemically treated genomic DNA (Homo sapiens) CpG-island No: 40367
gaaggagggggcgggtagggagaggttggagtcggtgacgtttttttttttcgcgttgcggtatgtaaagtatagtaggggggaggtggggttcggcgagcgatttttgcggatttgggaggttcgagcgttttcgttttatttgttacggtgtagttacgtgcgggggtggggtcgagttcgggaggtatttattttggagacgcggtagttgggggtcgtacgtttttcgaggtttaagattcgcgggtttgcggatcggacgtaggcggtagatttgtagttcgggatgcgttagggaatattttgcgtttttttttttttttttcggtcgttggtcgggtaaatttcggtttttgtcgcgcgtgtttggtttggagtttcgttgcgggaaaattcgagcgcgggcgggttttcgtttcgtcgttcggggaaattcgggggtggtcgttagggatttttaagcggtttgggttgggcggtcggagtttttttttcggatttgcgtttcgaatttggcgttttgaagttagaggttcgtcggtttagtttttgttttttatttttttttcgtagagcgtttagacgacggcgagatgacggtcgggagtttcgaagaatgcggggaggtgcggaggagtttcgagggtcgcgtttttcgtttgggtcgtcggttgggtcgacgtcggcgttcgcgtttttcgttt

SEQ ID NO: 40368 - DNA, 707 bp, Artificial Sequence
  chemically treated genomic DNA (Homo sapiens) CpG-island No: 40368
aaacgaaaaacgcgaacgccgacgtcgacccaaccgacgacccaaacgaaaaacgcgaccctcgaaactcctccgcacctccccgcattcttcgaaactcccgaccgtcatctcgccgtcgtctaaacgctctacgaaaaaaaaataaaaaacaaaaactaaaccgacgaacctctaacttcaaaacgccaaattcgaaacgcaaatccgaaaaaaaaactccgaccgcccaacccaaaccgcttaaaaatccctaacgaccacccccgaatttccccgaacgacgaaacgaaaacccgcccgcgctcgaattttcccgcaacgaaactccaaaccaaacacgcgcgacaaaaaccgaaatttacccgaccaacgaccgaaaaaaaaaaaaaaaaacgcaaaatattccctaacgcatcccgaactacaaatctaccgcctacgtccgatccgcaaacccgcgaatcttaaacctcgaaaaacgtacgacccccaactaccgcgtctccaaaataaatacctcccgaactcgaccccacccccgcacgtaactacaccgtaacaaataaaacgaaaacgctcgaacctcccaaatccgcaaaaatcgctcgccgaaccccacctcccccctactatactttacataccgcaacgcgaaaaaaaaaaacgtcaccgactccaacctctccctacccgccccctccttc

SEQ ID NO: 40369 - DNA, 598 bp, Artificial Sequence
  chemically treated genomic DNA (Homo sapiens) CpG-island No: 40369
ttttcgttcgtagcgaagttgtagtaggagcgatttgagttagatatcgggaagatcgttcggattaagattagttaggtagaggaggagaggcggcgtcgatttcgtttaagatttttattaagtttacgtatgagaggttttttttttttttagcggtcgtgttggggttacggtagtaggcgggggtgtcggtgtcgggcgttgggtttcgtcggacggatgttttttcggttttttcgtcggttcgggtaaggttgtttttaggttgcgacgtttttaattcgggttttttcggatgaattatttttttttttcgtcgtttggttttttttttcgtttttttcgttcgaggttttcgtggttcgtggttcggttagagtagtatcgtttttgcgtttcgggattcgggtcgtatagtttaagttttttcgattgttggtcgcgttttgtttgcggtttgtggtttggatttcgggtttagtaggagtagtcgagttgcgtgcggtgtggtttttacgaaagggagggcgagggagaagacgcggttttcgtttaggcgttttaggtcgtaggagaggaggtttagggtttagtt

SEQ ID NO: 40370 - DNA, 598 bp, Artificial Sequence
  chemically treated genomic DNA (Homo sapiens) CpG-island No: 40370
aactaaaccctaaacctcctctcctacgacctaaaacgcctaaacgaaaaccgcgtcttctccctcgccctccctttcgtaaaaaccacaccgcacgcaactcgactactcctactaaacccgaaatccaaaccacaaaccgcaaacaaaacgcgaccaacaatcgaaaaaacttaaactatacgacccgaatcccgaaacgcaaaaacgatactactctaaccgaaccacgaaccacgaaaacctcgaacgaaaaaaacgaaaaaaaaaaccaaacgacgaaaaaaaaaaataattcatccgaaaaaacccgaattaaaaacgtcgcaacctaaaaacaaccttacccgaaccgacgaaaaaaccgaaaaaacatccgtccgacgaaacccaacgcccgacaccgacacccccgcctactaccgtaaccccaacacgaccgctaaaaaaaaaaaaaacctctcatacgtaaacttaataaaaatcttaaacgaaatcgacgccgcctctcctcctctacctaactaatcttaatccgaacgatcttcccgatatctaactcaaatcgctcctactacaacttcgctacgaacgaaaa

SEQ ID NO: 40371 - DNA, 598 bp, Artificial Sequence
  chemically treated genomic DNA (Homo sapiens) CpG-island No: 40371
agttaggttttgagtttttttttttgcggtttggggcgtttgggcgggggtcgcgttttttttttcgttttttttttcgtgggggttatatcgtacgtagttcggttatttttgttgggttcgggatttaggttataggtcgtaggtagggcgcggttagtaatcgggagggtttaagttgtgcggttcggatttcgaggcgtaggggcggtgttgttttgatcgggttacgggttacggaggtttcgggcggaggaggcgggaaaggaggttaggcggcgggaaagggggatgatttattcggaggagttcgaattggaaacgtcgtaatttgggaatagttttgttcgggtcgacgggggagtcgggagggtattcgttcggcggggtttagcgttcggtatcggtattttcgtttgttgtcgtggttttagtacgatcgttgggggagggagaggttttttatgcgtggatttgatggaaattttgggcgaagtcggcgtcgtttttttttttttgtttggttggttttgattcgagcggttttttcggtgtttagtttaagtcgtttttgttgtagtttcgttgcgggcggagg

SEQ ID NO: 40372 - DNA, 598 bp, Artificial Sequence
  chemically treated genomic DNA (Homo sapiens) CpG-island No: 40372
cctccgcccgcaacgaaactacaacaaaaacgacttaaactaaacaccgaaaaaaccgctcgaatcaaaaccaaccaaacaaaaaaaaaaaaacgacgccgacttcgcccaaaatttccatcaaatccacgcataaaaaacctctccctcccccaacgatcgtactaaaaccacgacaacaaacgaaaataccgataccgaacgctaaaccccgccgaacgaataccctcccgactcccccgtcgacccgaacaaaactattcccaaattacgacgtttccaattcgaactcctccgaataaatcatccccctttcccgccgcctaacctcctttcccgcctcctccgcccgaaacctccgtaacccgtaacccgatcaaaacaacaccgcccctacgcctcgaaatccgaaccgcacaacttaaaccctcccgattactaaccgcgccctacctacgacctataacctaaatcccgaacccaacaaaaataaccgaactacgtacgatataacccccacgaaaaaaaaaacgaaaaaaaaaacgcgacccccgcccaaacgccccaaaccgcaaaaaaaaaaactcaaaacctaact

SEQ ID NO: 40373 - DNA, 554 bp, Artificial Sequence
  chemically treated genomic DNA (Homo sapiens) CpG-island No: 40373
cggcgaggcgggcgtttttcgttttttgttaattatttttcgggttatagtgggtagcgtcgtcgcggtttcgtagttatatggggcgggggaagcgaaggatagtaggacggcgggttatatattgggtttcggggtcgcgtattttagtgcgttcggttcggaaaatggttcggattcggagcggtagtagaaaaaagataggcggaaagaaaggaaagagagaggaaggatttgagtcgggaaagggaaggggaagcgagaatgagcggtttttcgacggtagagtttgtaaggacggcgagcggttagaattaaaatatttttttttttttgttcgcgcgtcgttatttttgcgtagtcgtatttcggatagcgtcgttacggaaatatcgtcggaacgagatgggcgggatttaggggttggaagatagttttttggtgtttttcggtcgtcgttaggttatttttaacggttgtttggttattgttggatggaagtggacgagttggggttaagggaatttggtttttggtcgtcgattttcgatttt

SEQ ID NO: 40374 - DNA, 554 bp, Artificial Sequence
  chemically treated genomic DNA (Homo sapiens) CpG-island No: 40374
aaaatcgaaaatcgacgaccaaaaaccaaattcccttaaccccaactcgtccacttccatccaacaataaccaaacaaccgttaaaaataacctaacgacgaccgaaaaacaccaaaaaactatcttccaacccctaaatcccgcccatctcgttccgacgatatttccgtaacgacgctatccgaaatacgactacgcaaaaataacgacgcgcgaacaaaaaaaaaaaaatattttaattctaaccgctcgccgtccttacaaactctaccgtcgaaaaaccgctcattctcgcttccccttccctttcccgactcaaatccttcctctctctttcctttctttccgcctatcttttttctactaccgctccgaatccgaaccattttccgaaccgaacgcactaaaatacgcgaccccgaaacccaatatataacccgccgtcctactatccttcgcttcccccgccccatataactacgaaaccgcgacgacgctacccactataacccgaaaaataattaacaaaaaacgaaaaacgcccgcctcgccg

SEQ ID NO: 40375 - DNA, 554 bp, Artificial Sequence
  chemically treated genomic DNA (Homo sapiens) CpG-island No: 40375
ggggtcggaggtcggcggttagaagttagatttttttggttttagttcgtttatttttatttagtagtagttaaataatcgttgaaaatggtttggcggcggtcgggaaatattagagaattattttttaatttttagatttcgtttatttcgtttcggcggtgttttcgtggcgacgttattcgaagtgcggttgcgtaagggtgacggcgcgcgagtaagggggagggggtgttttggttttagtcgttcgtcgtttttgtaggttttgtcgtcggaaagtcgtttattttcgtttttttttttttttttcggtttaagttttttttttttttttttttttttttcgtttattttttttttgttgtcgtttcgggttcgggttatttttcgggtcgggcgtattaaggtgcgcggtttcggggtttagtatatgattcgtcgttttgttatttttcgtttttttcgttttatgtggttgcggggtcgcggcggcgttgtttattatggttcggaaagtagttagtaggaagcggaaagcgttcgtttcgtcg

SEQ ID NO: 40376 - DNA, 554 bp, Artificial Sequence
  chemically treated genomic DNA (Homo sapiens) CpG-island No: 40376
cgacgaaacgaacgctttccgcttcctactaactactttccgaaccataataaacaacgccgccgcgaccccgcaaccacataaaacgaaaaaaacgaaaaataacaaaacgacgaatcatatactaaaccccgaaaccgcgcaccttaatacgcccgacccgaaaaataacccgaacccgaaacgacaacaaaaaaaaaataaacgaaaaaaaaaaaaaaaaaaaaaaaaaacttaaaccgaaaaaaaaaaaaaaaaacgaaaataaacgactttccgacgacaaaacctacaaaaacgacgaacgactaaaaccaaaacaccccctcccccttactcgcgcgccgtcacccttacgcaaccgcacttcgaataacgtcgccacgaaaacaccgccgaaacgaaataaacgaaatctaaaaattaaaaaataattctctaatatttcccgaccgccgccaaaccattttcaacgattatttaactactactaaataaaaataaacgaactaaaaccaaaaaaatctaacttctaaccgccgacctccgacccc

SEQ ID NO: 40377 - DNA, 912 bp, Artificial Sequence
  chemically treated genomic DNA (Homo sapiens) CpG-island No: 40377
gaaggttcgaaggtttagtttattaagtttagttaattgttcgttggatgtttatatttttcggggtcgagcgtcgtgtagttgtttattatagcgttttaattaagtgcgtagtttagagatttggtagtcgtcggggttacggtcgttttggtatataatagtgttattttggatgatatagagacgttcgaagtaggcgttataggtcgagttgttggagttggttatggtgtcgaggattagagcgtagtcgggtgtattttgttgtagtattttcgttgcgttgattcggttttttaggtttcggtgttgtgggatgatgtagggagagttcgtggtgatttagtcgtcggaggggtgcgttttttcgatgtagatgatgaggaagtcgacgtcgcgttggtatttagtgattaggcgttggaaggcgtttatgcgcgttatgaacggtggttaggtgtagttgtcgaaattgagaattagcgggcggtttttttgcgcgtagtcgaggatgtgttggttttggaagtcgtcgggtagaattatttcggagttgggcgtcggatcgttttcgtgcgtttgtttgaagaaatttaatttttggttatgttatatcgttttgagcgacgttagggtgtataggcggttgtcgtcggatacgtagatgggcgggttatcgggaggtattttttcgtttttattgttgagttttatttcgggttcgggttgttttcggcggcggcggtttaggaaatgtttgcggatatataagaaatcgagaagttagagtatgaaggtcgtgtcgaggaagcgcgggaagagtacgaggtacgaggcggtttgggcgtagagttttaaggagtgaagtagtagggagcggagtatggtggttgtaggtttcgaagtttt

SEQ ID NO: 40378 - DNA, 912 bp, Artificial Sequence
  chemically treated genomic DNA (Homo sapiens) CpG-island No: 40378
aaaacttcgaaacctacaaccaccatactccgctccctactacttcactccttaaaactctacgcccaaaccgcctcgtacctcgtactcttcccgcgcttcctcgacacgaccttcatactctaacttctcgatttcttatatatccgcaaacatttcctaaaccgccgccgccgaaaacaacccgaacccgaaataaaactcaacaataaaaacgaaaaaatacctcccgataacccgcccatctacgtatccgacgacaaccgcctatacaccctaacgtcgctcaaaacgatataacataaccaaaaattaaatttcttcaaacaaacgcacgaaaacgatccgacgcccaactccgaaataattctacccgacgacttccaaaaccaacacatcctcgactacgcgcaaaaaaaccgcccgctaattctcaatttcgacaactacacctaaccaccgttcataacgcgcataaacgccttccaacgcctaatcactaaataccaacgcgacgtcgacttcctcatcatctacatcgaaaaaacgcacccctccgacgactaaatcaccacgaactctccctacatcatcccacaacaccgaaacctaaaaaaccgaatcaacgcaacgaaaatactacaacaaaatacacccgactacgctctaatcctcgacaccataaccaactccaacaactcgacctataacgcctacttcgaacgtctctatatcatccaaaataacactattatataccaaaacgaccgtaaccccgacgactaccaaatctctaaactacgcacttaattaaaacgctataataaacaactacacgacgctcgaccccgaaaaatataaacatccaacgaacaattaactaaacttaataaactaaaccttcgaaccttc

SEQ ID NO: 40379 - DNA, 912 bp, Artificial Sequence
  chemically treated genomic DNA (Homo sapiens) CpG-island No: 40379
ggggtttcggggtttgtagttattatgtttcgttttttgttgttttattttttgaggttttgcgtttagatcgtttcgtgtttcgtgtttttttcgcgttttttcggtacggtttttatgttttggtttttcgattttttgtgtattcgtaagtattttttgggtcgtcgtcgtcgggggtagttcgagttcgaagtggagtttaatagtgaaggcgaggaggtgtttttcgatgattcgtttatttgcgtgttcgacgataatcgtttgtgtattttggcgtcgtttaaggcggtgtggtatggttagaagttggatttttttaagtaggcgtacgagggcggttcggcgtttaatttcgaggtggttttgttcgacggtttttagagttagtatattttcgattacgcgtaagggaatcgttcgttggtttttaatttcggtagttgtatttgattatcgtttatggcgcgtatgagcgttttttagcgtttggttattaagtattagcgcgacgtcgatttttttattatttatatcgaggaagcgtattttttcgacggttgggttattacggattttttttatattattttatagtatcggagtttggaggatcgggttagcgtagcgagggtattgtagtaaggtgtattcggttgcgttttggttttcgatattatggttaattttagtagttcggtttatggcgtttatttcgagcgtttttatgttatttagagtggtattattatgtattagggcggtcgtggtttcgacggttattaggtttttgagttgcgtatttggttggaacgttatgatgagtaattgtacggcgttcggtttcggagggtgtaaatatttaacggataattgattgaatttggtgggttgggttttcgagttttt

SEQ ID NO: 40380 - DNA, 912 bp, Artificial Sequence
  chemically treated genomic DNA (Homo sapiens) CpG-island No: 40380
aaaaactcgaaaacccaacccaccaaattcaatcaattatccgttaaatatttacaccctccgaaaccgaacgccgtacaattactcatcataacgttccaaccaaatacgcaactcaaaaacctaataaccgtcgaaaccacgaccgccctaatacataataataccactctaaataacataaaaacgctcgaaataaacgccataaaccgaactactaaaattaaccataatatcgaaaaccaaaacgcaaccgaatacaccttactacaataccctcgctacgctaacccgatcctccaaactccgatactataaaataatataaaaaaaatccgtaataacccaaccgtcgaaaaaatacgcttcctcgatataaataataaaaaaatcgacgtcgcgctaatacttaataaccaaacgctaaaaaacgctcatacgcgccataaacgataatcaaatacaactaccgaaattaaaaaccaacgaacgattcccttacgcgtaatcgaaaatatactaactctaaaaaccgtcgaacaaaaccacctcgaaattaaacgccgaaccgccctcgtacgcctacttaaaaaaatccaacttctaaccataccacaccgccttaaacgacgccaaaatacacaaacgattatcgtcgaacacgcaaataaacgaatcatcgaaaaacacctcctcgccttcactattaaactccacttcgaactcgaactacccccgacgacgacgacccaaaaaatacttacgaatacacaaaaaatcgaaaaaccaaaacataaaaaccgtaccgaaaaaacgcgaaaaaaacacgaaacacgaaacgatctaaacgcaaaacctcaaaaaataaaacaacaaaaaacgaaacataataactacaaaccccgaaacccc

SEQ ID NO: 40381 - DNA, 1369 bp, Artificial Sequence
  chemically treated genomic DNA (Homo sapiens) CpG-island No: 40381
cggagggattatttagtagcgcggttaatgttttagaaattttgggttgagggcgggcgtaggcgggcggagggcggagcggtcgggtttggggtcggtgggggcgggttcgggtttcgtagttagttttcgggggcgggggatttcggtagtcgttgtcgttggggatcgggagttcgattagggatttgggcgttcgttggggaggttttttagttggcgcgagcgttgcgcgtcgttttggttttcgtcgtttggtttcggttcgcgtttttttcgtcgcgtatttgagtcgagtttttcggcggtcgtcgagtcgcgtcggagtttcggttcgtttttcgcgcgtcgtcgttaacgtcgtttacgtcgttgtcgttcgtgcggggtcgttgtttaggtgtcgcgggaggtcgggttcgcggtcgtcgtttcggtggtttcggttttcgttttatcgaggacgcgggttagcgaggaggtaattttgcgttttcgtcgtttttttggttcgttcgcgggcgtcgttcgtttgtcggagttcgttcgttcgtttttcgcgcgcgtttatattcgcgtttcgtatacggtcgtttttcgtatcgtttcgttacgtatacgtcgttcgcgtttttcgtcgttgttcgaggttgtcgcgcgtcgttttagttcgcgtcgttttggtcgcgttcgtttcgttttatttcgttttagcggggcgtcgcggtttttgggttagcggtcgtcggggtcgggttgagaggtgcggagggtagagttcgcgggcgggttatcgtcgggcgtcggagatcggagagttggggaaagcggcgtcggttttgcgtttttagtcgattcgggcgcggggcgttacgggcgtggggcgcggggtagcgggcgcggggcggcgtcggtttcgggcggtttttttattaggggtagttgttgtttgaacgtcggagcgtttttttttcgtcgtttgtttcgtttagcgtagtttcggtcgttgggcgtattcgtttcgttcgttttcggacgttgttttttatttcgggaacgtcgagattggagcgttcgaattgagttattttcgcggatttcgagagcggcggcgcgatttatcgcggaggcgttcggacgcgttaagtgcgtatttttaatcgtaaatgggtgttgagcgtttaggggtgcggggtaattttttaattcgtggggttttggtcggttttgtcgcggcgttcgagattttttgatttttcgttgcgcgcggcgcggggttggcgatttgggtttaggggcggcggggcggggaggtgttttgatttagggatttagaggtcgggagtaagttttttttcgttttggattg

SEQ ID NO: 40382 - DNA, 1369 bp, Artificial Sequence
  chemically treated genomic DNA (Homo sapiens) CpG-island No: 40382
caatccaaaacgaaaaaaaacttactcccgacctctaaatccctaaatcaaaacacctccccgccccgccgcccctaaacccaaatcgccaaccccgcgccgcgcgcaacgaaaaatcaaaaaatctcgaacgccgcgacaaaaccgaccaaaaccccacgaattaaaaaattaccccgcacccctaaacgctcaacacccatttacgattaaaaatacgcacttaacgcgtccgaacgcctccgcgataaatcgcgccgccgctctcgaaatccgcgaaaataactcaattcgaacgctccaatctcgacgttcccgaaataaaaaacaacgtccgaaaacgaacgaaacgaatacgcccaacgaccgaaactacgctaaacgaaacaaacgacgaaaaaaaaacgctccgacgttcaaacaacaactacccctaataaaaaaaccgcccgaaaccgacgccgccccgcgcccgctaccccgcgccccacgcccgtaacgccccgcgcccgaatcgactaaaaacgcaaaaccgacgccgctttccccaactctccgatctccgacgcccgacgataacccgcccgcgaactctaccctccgcacctctcaacccgaccccgacgaccgctaacccaaaaaccgcgacgccccgctaaaacgaaataaaacgaaacgaacgcgaccaaaacgacgcgaactaaaacgacgcgcgacaacctcgaacaacgacgaaaaacgcgaacgacgtatacgtaacgaaacgatacgaaaaacgaccgtatacgaaacgcgaatataaacgcgcgcgaaaaacgaacgaacgaactccgacaaacgaacgacgcccgcgaacgaaccaaaaaaacgacgaaaacgcaaaattacctcctcgctaacccgcgtcctcgataaaacgaaaaccgaaaccaccgaaacgacgaccgcgaacccgacctcccgcgacacctaaacaacgaccccgcacgaacgacaacgacgtaaacgacgttaacgacgacgcgcgaaaaacgaaccgaaactccgacgcgactcgacgaccgccgaaaaactcgactcaaatacgcgacgaaaaaaacgcgaaccgaaaccaaacgacgaaaaccaaaacgacgcgcaacgctcgcgccaactaaaaaacctccccaacgaacgcccaaatccctaatcgaactcccgatccccaacgacaacgactaccgaaatcccccgcccccgaaaactaactacgaaacccgaacccgcccccaccgaccccaaacccgaccgctccgccctccgcccgcctacgcccgccctcaacccaaaatttctaaaacattaaccgcgctactaaataatccctccg

SEQ ID NO: 40383 - DNA, 1369 bp, Artificial Sequence
  chemically treated genomic DNA (Homo sapiens) CpG-island No: 40383
tagtttaaggcgaaaggagatttgttttcggtttttgggtttttaggttaaggtattttttcgtttcgtcgtttttgagtttaagtcgttaatttcgcgtcgcgcgtagcgagggattagaaggtttcggacgtcgcggtagggtcggttagggttttacgagttagggagttgtttcgtatttttaaacgtttagtatttatttacggttgaaagtacgtatttgacgcgttcgggcgttttcgcggtgagtcgcgtcgtcgttttcggggttcgcgaaggtggtttagttcgggcgttttagtttcgacgttttcggggtagagagtaacgttcggggacgaacgggacgggtgcgtttagcggtcggggttgcgttgggcgaggtaagcggcgagaggggagcgtttcggcgtttaggtaatagttatttttagtgggagagtcgttcggggtcggcgtcgtttcgcgttcgttgtttcgcgttttacgttcgtggcgtttcgcgttcgggtcggttgggggcgtagggtcggcgtcgttttttttagtttttcggttttcggcgttcggcggtaattcgttcgcgggttttgtttttcgtattttttagttcggtttcggcggtcgttgatttaggaatcgcggcgtttcgttggaacgagatgggacggggcgggcgcggttagggcggcgcgggttggggcggcgcgcggtagtttcgggtagcggcggggggcgcggacggcgtgtgcgtggcggggcggtgcggggggcggtcgtgtgcgaggcgcgagtgtgagcgcgcgcgggaggcgggcgggcgggtttcggtaggcgagcggcgttcgcgggcgagttaggaaggcggcgggaacgtaaagttgttttttcgttggttcgcgttttcggtggggcgggagtcggggttatcgaagcggcggtcgcggattcggtttttcgcggtatttgggtagcggtttcgtacgagcggtagcggcgtgggcggcgttggcggcggcgcgcgggaagcgaatcggagtttcggcgcggttcggcggtcgtcggggagttcggtttaggtgcgcggcgaggggggcgcgggtcggagttaggcggcggggattagggcggcgcgtagcgttcgcgttagttggaggatttttttagcggacgtttaggtttttggtcgggttttcggtttttagcggtagcggttgtcggagtttttcgttttcgagagttggttgcggggttcgggttcgtttttatcggttttaggttcggtcgtttcgtttttcgttcgtttgcgttcgtttttagtttaagatttttagggtattggtcgcgttgttgggtgattttttcg

SEQ ID NO: 40384 - DNA, 1369 bp, Artificial Sequence
  chemically treated genomic DNA (Homo sapiens) CpG-island No: 40384
cgaaaaaatcacccaacaacgcgaccaataccctaaaaatcttaaactaaaaacgaacgcaaacgaacgaaaaacgaaacgaccgaacctaaaaccgataaaaacgaacccgaaccccgcaaccaactctcgaaaacgaaaaactccgacaaccgctaccgctaaaaaccgaaaacccgaccaaaaacctaaacgtccgctaaaaaaatcctccaactaacgcgaacgctacgcgccgccctaatccccgccgcctaactccgacccgcgcccccctcgccgcgcacctaaaccgaactccccgacgaccgccgaaccgcgccgaaactccgattcgcttcccgcgcgccgccgccaacgccgcccacgccgctaccgctcgtacgaaaccgctacccaaataccgcgaaaaaccgaatccgcgaccgccgcttcgataaccccgactcccgccccaccgaaaacgcgaaccaacgaaaaaacaactttacgttcccgccgccttcctaactcgcccgcgaacgccgctcgcctaccgaaacccgcccgcccgcctcccgcgcgcgctcacactcgcgcctcgcacacgaccgccccccgcaccgccccgccacgcacacgccgtccgcgccccccgccgctacccgaaactaccgcgcgccgccccaacccgcgccgccctaaccgcgcccgccccgtcccatctcgttccaacgaaacgccgcgattcctaaatcaacgaccgccgaaaccgaactaaaaaatacgaaaaacaaaacccgcgaacgaattaccgccgaacgccgaaaaccgaaaaactaaaaaaaacgacgccgaccctacgcccccaaccgacccgaacgcgaaacgccacgaacgtaaaacgcgaaacaacgaacgcgaaacgacgccgaccccgaacgactctcccactaaaaataactattacctaaacgccgaaacgctcccctctcgccgcttacctcgcccaacgcaaccccgaccgctaaacgcacccgtcccgttcgtccccgaacgttactctctaccccgaaaacgtcgaaactaaaacgcccgaactaaaccaccttcgcgaaccccgaaaacgacgacgcgactcaccgcgaaaacgcccgaacgcgtcaaatacgtactttcaaccgtaaataaatactaaacgtttaaaaatacgaaacaactccctaactcgtaaaaccctaaccgaccctaccgcgacgtccgaaaccttctaatccctcgctacgcgcgacgcgaaattaacgacttaaactcaaaaacgacgaaacgaaaaaataccttaacctaaaaacccaaaaaccgaaaacaaatctcctttcgccttaaacta

SEQ ID NO: 40385 - DNA, 500 bp, Artificial Sequence
  chemically treated genomic DNA (Homo sapiens) CpG-island No: 40385
gttcgtagtcggggcggggtagcgggattcgagaggacgggaatttttgtagggagggaagggtcgcgtttgtcgaggcggtttcgagtttcgttattcggttttatttcggttcgcggaggtttaggtttcgggaattgcgggcggagggggcggcgatcgggtattttgcggttattgcggtcgttgtttttgcgattttcgcgttcgtcgggtggtggttttttagtgttcgtttttagtttttttttttcgttttttacgtttttttttcgtttcggttttcgttcggcgttcgggtcgcgtcgattcgtcgtttcgttttttcgagcgcgttaggcggtagatttttggcggcggcggcgtttttttagtgtcggcggtttcgagtcggttgtcgcgtttcgggttttagagttttttcgtttcggttatttttttttttttttattttttttttttagtttttttttttttcgatttttatttttttgtttttt

SEQ ID NO: 40386 - DNA, 500 bp, Artificial Sequence
  chemically treated genomic DNA (Homo sapiens) CpG-island No: 40386
aaaaaacaaaaaaataaaaatcgaaaaaaaaaaaaactaaaaaaaaaaaataaaaaaaaaaaaaaataaccgaaacgaaaaaactctaaaacccgaaacgcgacaaccgactcgaaaccgccgacactaaaaaaacgccgccgccgccaaaaatctaccgcctaacgcgctcgaaaaaacgaaacgacgaatcgacgcgacccgaacgccgaacgaaaaccgaaacgaaaaaaaaacgtaaaaaacgaaaaaaaaaaactaaaaacgaacactaaaaaaccaccacccgacgaacgcgaaaatcgcaaaaacaacgaccgcaataaccgcaaaatacccgatcgccgccccctccgcccgcaattcccgaaacctaaacctccgcgaaccgaaataaaaccgaataacgaaactcgaaaccgcctcgacaaacgcgacccttccctccctacaaaaattcccgtcctctcgaatcccgctaccccgccccgactacgaac

SEQ ID NO: 40387 - DNA, 500 bp, Artificial Sequence
  chemically treated genomic DNA (Homo sapiens) CpG-island No: 40387
ggagggtaaggggatgaggatcgggaggggaggggattaaggggaggagatggggaggagggaaaatggtcgaggcgggaggattttgaggttcggaacgcggtagtcggttcggggtcgtcggtattggggaggcgtcgtcgtcgttaagaatttgtcgtttggcgcgttcggaaggacggggcgacgggtcggcgcggttcgagcgtcgggcgggggtcggggcgggaagggggcgtgaggggcggggaaggggagttgggggcgggtattggggagttattattcggcgggcgcgggagtcgtaggagtagcggtcgtagtggtcgtagggtgttcggtcgtcgtttttttcgttcgtagttttcggggtttgagttttcgcgagtcgggataggatcgagtggcggggttcggagtcgtttcggtaggcgcggtttttttttttttgtagggattttcgttttttcgggtttcgttgtttcgtttcgattgcggat

SEQ ID NO: 40388 - DNA, 500 bp, Artificial Sequence
  chemically treated genomic DNA (Homo sapiens) CpG-island No: 40388
atccgcaatcgaaacgaaacaacgaaacccgaaaaaacgaaaatccctacaaaaaaaaaaaaaccgcgcctaccgaaacgactccgaaccccgccactcgatcctatcccgactcgcgaaaactcaaaccccgaaaactacgaacgaaaaaaacgacgaccgaacaccctacgaccactacgaccgctactcctacgactcccgcgcccgccgaataataactccccaatacccgcccccaactccccttccccgcccctcacgcccccttcccgccccgacccccgcccgacgctcgaaccgcgccgacccgtcgccccgtccttccgaacgcgccaaacgacaaattcttaacgacgacgacgcctccccaataccgacgaccccgaaccgactaccgcgttccgaacctcaaaatcctcccgcctcgaccattttccctcctccccatctcctccccttaatcccctcccctcccgatcctcatccccttaccctcc

SEQ ID NO: 40389 - DNA, 715 bp, Artificial Sequence
  chemically treated genomic DNA (Homo sapiens) CpG-island No: 40389
gttgtcgcgtcgttagttttcgtttttcgttgttcggttttgcgtttcgtcgagcgatgagcgttttttcggttttgcggtcgtttagttcgttgttgttcgtggcggcggtagttgtcgtagcggtcgtcgtattggttttagggttcgggttcgggttcgcgtcgtttttggtttttgtcgcggtttcggtcgggggtatttcgttttatttgtagatcggtttgagtcgtgagtcggtgttgttgttgtaggattcgttcggggattatagtttggcgtacgttcgcgagatggtttgttttattgtcgattagaaggtaagtcgtcgtatcgttgttagttcggcgttttttcgcggcgtagggggcgttgttcggttggtttttttcgcgttaatttttcggttttcggggttcggttggtcgttagtttcgtcggcgttttggaagcggttggtttcgtcgcggttggacgtttgtaattcgaggcgttgcgttcgttgttgtttatttttttttcgttttatttttttttatttatcgatttttttttagttcgtcgtttttttatttatttttattttttttatgatatttttaggtattttgtttttttttcgtcgcgtttttttttgtttttgagattttttagtttttttttttttttttttttacggattttggattagcgtatttttggtgtaggaattttt

SEQ ID NO: 40390 - DNA, 715 bp, Artificial Sequence
  chemically treated genomic DNA (Homo sapiens) CpG-island No: 40390
aaaaattcctacaccaaaaatacgctaatccaaaatccgtaaaaaaaaaaaaaaaaaaaaactaaaaaatctcaaaaacaaaaaaaaacgcgacgaaaaaaaaacaaaatacctaaaaatatcataaaaaaaataaaaataaataaaaaaacgacgaactaaaaaaaaatcgataaataaaaaaaaataaaacgaaaaaaaaataaacaacaacgaacgcaacgcctcgaattacaaacgtccaaccgcgacgaaaccaaccgcttccaaaacgccgacgaaactaacgaccaaccgaaccccgaaaaccgaaaaattaacgcgaaaaaaaccaaccgaacaacgccccctacgccgcgaaaaaacgccgaactaacaacgatacgacgacttaccttctaatcgacaataaaacaaaccatctcgcgaacgtacgccaaactataatccccgaacgaatcctacaacaacaacaccgactcacgactcaaaccgatctacaaataaaacgaaatacccccgaccgaaaccgcgacaaaaaccaaaaacgacgcgaacccgaacccgaaccctaaaaccaatacgacgaccgctacgacaactaccgccgccacgaacaacaacgaactaaacgaccgcaaaaccgaaaaaacgctcatcgctcgacgaaacgcaaaaccgaacaacgaaaaacgaaaactaacgacgcgacaac

SEQ ID NO: 40391 - DNA, 715 bp, Artificial Sequence
  chemically treated genomic DNA (Homo sapiens) CpG-island No: 40391
gaggatttttgtattaggaatgcgttggtttagggttcgtaggggagagaggggaagaaaattgggaagttttaaggataaggaggggcgcggcgaggaaagggtaagatatttggaaatgttatgagaaggatggaaatgggtgaggaggcggcggattggagagaaatcggtgaatagaggaagatggggcgagaggaggatgagtaatagcgagcgtagcgtttcgggttgtaggcgtttagtcgcggcggggttagtcgtttttagagcgtcggcgaggttggcggttagtcgagtttcgggagtcggaaagttggcgcggagagggttagtcgggtagcgttttttgcgtcgcggggaggcgtcgggttggtagcggtgcggcgatttattttttggtcgataatggagtaagttatttcgcggacgtgcgttaggttgtagttttcggacgagttttgtagtagtagtatcggtttacggtttaggtcgatttgtagatggaacgagatgttttcgatcggggtcgcgataggagttaagaacggcgcgggttcgggttcggattttgggattagtgcggcggtcgttgcggtagttgtcgtcgttacgggtagtagcggattgggcggtcgtaggatcggaggggcgtttatcgttcggcggggcgtagggtcgggtagcggagggcgggggttggcggcgcggtagt

SEQ ID NO: 40392 - DNA, 715 bp, Artificial Sequence
  chemically treated genomic DNA (Homo sapiens) CpG-island No: 40392
actaccgcgccgccaacccccgccctccgctacccgaccctacgccccgccgaacgataaacgcccctccgatcctacgaccgcccaatccgctactacccgtaacgacgacaactaccgcaacgaccgccgcactaatcccaaaatccgaacccgaacccgcgccgttcttaactcctatcgcgaccccgatcgaaaacatctcgttccatctacaaatcgacctaaaccgtaaaccgatactactactacaaaactcgtccgaaaactacaacctaacgcacgtccgcgaaataacttactccattatcgaccaaaaaataaatcgccgcaccgctaccaacccgacgcctccccgcgacgcaaaaaacgctacccgactaaccctctccgcgccaactttccgactcccgaaactcgactaaccgccaacctcgccgacgctctaaaaacgactaaccccgccgcgactaaacgcctacaacccgaaacgctacgctcgctattactcatcctcctctcgccccatcttcctctattcaccgatttctctccaatccgccgcctcctcacccatttccatccttctcataacatttccaaatatcttaccctttcctcgccgcgcccctccttatccttaaaacttcccaattttcttcccctctctcccctacgaaccctaaaccaacgcattcctaatacaaaaatcctc

SEQ ID NO: 40393 - DNA, 562 bp, Artificial Sequence
  chemically treated genomic DNA (Homo sapiens) CpG-island No: 40393
ttcgggcggggatagtttattacgtgttgttagacggaacggggcggggtaggttattggttgcggagtgagttgggcgcgcggcgcgtaggcgttttggggattcggtagcggcggtggcggtggcggcggtggcggtggttgcggcgacggtagaggcgaagggagtcggatcgtcgatttgagcgggaggcggcggtggcggttatggcggtagatggagagcgtttttcgttgttgtttgagtttatcgacggtggcgcgggcggtaacggtttagtggggttcggcgggagtggggttgggttcgggggaggtttgatttttttcgtattatcgtacggagtcggtaaatatgtttcgttttagggtaagtcggggcgggttcgaggtgtttttcggggtattttgaaagtcggggagggggcgggatcgagggcggaggcgggttttagtcgttaggtgcgggattgttgtatttgtgattgggcgaggttttttttttttcgtaatcgcgattatagtttagggacggaagggggttttgagtaatttgatagaa

SEQ ID NO: 40394 - DNA, 562 bp, Artificial Sequence
  chemically treated genomic DNA (Homo sapiens) CpG-island No: 40394
ttctatcaaattactcaaaacccccttccgtccctaaactataatcgcgattacgaaaaaaaaaaaacctcgcccaatcacaaatacaacaatcccgcacctaacgactaaaacccgcctccgccctcgatcccgccccctccccgactttcaaaataccccgaaaaacacctcgaacccgccccgacttaccctaaaacgaaacatatttaccgactccgtacgataatacgaaaaaaatcaaacctcccccgaacccaaccccactcccgccgaaccccactaaaccgttaccgcccgcgccaccgtcgataaactcaaacaacaacgaaaaacgctctccatctaccgccataaccgccaccgccgcctcccgctcaaatcgacgatccgactcccttcgcctctaccgtcgccgcaaccaccgccaccgccgccaccgccaccgccgctaccgaatccccaaaacgcctacgcgccgcgcgcccaactcactccgcaaccaataacctaccccgccccgttccgtctaacaacacgtaataaactatccccgcccgaa

SEQ ID NO: 40395 - DNA, 562 bp, Artificial Sequence
  chemically treated genomic DNA (Homo sapiens) CpG-island No: 40395
ttttattaggttgtttagaattttttttcgtttttaggttgtggtcgcgattacggagggaaggaagtttcgtttagttataggtgtagtagtttcgtatttggcgattgggattcgttttcgttttcggtttcgtttttttttcggtttttagagtatttcggggagtatttcggattcgtttcggtttattttggggcggggtatgtttatcggtttcgtacggtggtgcggagggggttaggtttttttcgggtttagttttattttcgtcgggttttattaaatcgttgtcgttcgcgttatcgtcgatgggtttagatagtagcggggaacgttttttatttgtcgttatggtcgttatcgtcgtttttcgtttaggtcggcgattcggtttttttcgtttttgtcgtcgtcgtagttatcgttatcgtcgttatcgttatcgtcgttatcgggtttttagggcgtttgcgcgtcgcgcgtttagtttatttcgtaattagtggtttgtttcgtttcgtttcgtttagtagtacgtgataggttattttcgttcggg

SEQ ID NO: 40396 - DNA, 562 bp, Artificial Sequence
  chemically treated genomic DNA (Homo sapiens) CpG-island No: 40396
cccgaacgaaaataacctatcacgtactactaaacgaaacgaaacgaaacaaaccactaattacgaaataaactaaacgcgcgacgcgcaaacgccctaaaaacccgataacgacgataacgataacgacgataacgataactacgacgacgacaaaaacgaaaaaaaccgaatcgccgacctaaacgaaaaacgacgataacgaccataacgacaaataaaaaacgttccccgctactatctaaacccatcgacgataacgcgaacgacaacgatttaataaaacccgacgaaaataaaactaaacccgaaaaaaacctaaccccctccgcaccaccgtacgaaaccgataaacataccccgccccaaaataaaccgaaacgaatccgaaatactccccgaaatactctaaaaaccgaaaaaaaaacgaaaccgaaaacgaaaacgaatcccaatcgccaaatacgaaactactacacctataactaaacgaaacttccttccctccgtaatcgcgaccacaacctaaaaacgaaaaaaaattctaaacaacctaataaaa

SEQ ID NO: 40397 - DNA, 559 bp, Artificial Sequence
  chemically treated genomic DNA (Homo sapiens) CpG-island No: 40397
tcggggatatcgggttagggcgtcggggttagattcgggttttttcgtcggttatcgattcgcgcggcggagaatcggttcgtgcgttttgtcgaggggtcgtttggcgtttaggttttcggttatcgtttttcgcgtcgcgtttattttgttggttagcgggggttgcgttcgtttcgtttcgagggtcggtgtcggggcgcgttttggacgggttggggtcgcgcgaggatagcggtcgttcgcgtcgtcggaatgttgatgtcgtaggcggtcgcgacgttcggtggtcgtttgggatttttcgttttacggcggtagttgtagttcggagtcgcgtgatttcgggttcgattttttcgcgttcggttgtttgtgcgtatataaaagagaatatttatattttttttttttcggtatagattttatattcgtttcgttttttttttttcgtaatttttcgttttatatacgtttcgttgagaatttttttttttttgcgtatttattgtgtttcgttttttttttttttttaattttatagttgtattcgaggatg

SEQ ID NO: 40398 - DNA, 559 bp, Artificial Sequence
  chemically treated genomic DNA (Homo sapiens) CpG-island No: 40398
catcctcgaatacaactataaaattaaaaaaaaaaaaaaaacgaaacacaataaatacgcaaaaaaaaaaaaattctcaacgaaacgtatataaaacgaaaaattacgaaaaaaaaaaaacgaaacgaatataaaatctataccgaaaaaaaaaaaatataaatattctcttttatatacgcacaaacaaccgaacgcgaaaaaatcgaacccgaaatcacgcgactccgaactacaactaccgccgtaaaacgaaaaatcccaaacgaccaccgaacgtcgcgaccgcctacgacatcaacattccgacgacgcgaacgaccgctatcctcgcgcgaccccaacccgtccaaaacgcgccccgacaccgaccctcgaaacgaaacgaacgcaacccccgctaaccaacaaaataaacgcgacgcgaaaaacgataaccgaaaacctaaacgccaaacgacccctcgacaaaacgcacgaaccgattctccgccgcgcgaatcgataaccgacgaaaaaacccgaatctaaccccgacgccctaacccgatatccccga

SEQ ID NO: 40399 - DNA, 559 bp, Artificial Sequence
  chemically treated genomic DNA (Homo sapiens) CpG-island No: 40399
tattttcgaatataattatggaattaaagaggagagaaaggcgaggtatagtgggtgcgtaaagaaaaagaggtttttagcggagcgtgtgtgaggcggggggttacgggggaggggagacggggcgggtgtgaagtttgtgtcgggaaaagaaaaatatgagtgtttttttttgtgtgcgtataaatagtcgagcgcggggaggtcgggttcggggttacgcggtttcgggttgtagttgtcgtcgtggggcggggggttttaggcggttatcgggcgtcgcggtcgtttgcggtattagtatttcggcggcgcgggcggtcgttgttttcgcgcgattttagttcgtttagagcgcgtttcggtatcgattttcggggcgaggcgagcgtagttttcgttggttaataaggtaagcgcggcgcggggagcggtggtcgggagtttgggcgttaggcgatttttcgatagggcgtacggatcggtttttcgtcgcgcgggtcgatgatcgacggggaggttcgagtttggtttcgacgttttggttcggtgttttcga

SEQ ID NO: 40400 - DNA, 559 bp, Artificial Sequence
  chemically treated genomic DNA (Homo sapiens) CpG-island No: 40400
tcgaaaacaccgaaccaaaacgtcgaaaccaaactcgaacctccccgtcgatcatcgacccgcgcgacgaaaaaccgatccgtacgccctatcgaaaaatcgcctaacgcccaaactcccgaccaccgctccccgcgccgcgcttaccttattaaccaacgaaaactacgctcgcctcgccccgaaaatcgataccgaaacgcgctctaaacgaactaaaatcgcgcgaaaacaacgaccgcccgcgccgccgaaatactaataccgcaaacgaccgcgacgcccgataaccgcctaaaaccccccgccccacgacgacaactacaacccgaaaccgcgtaaccccgaacccgacctccccgcgctcgactatttatacgcacacaaaaaaaaacactcatatttttcttttcccgacacaaacttcacacccgccccgtctcccctcccccgtaaccccccgcctcacacacgctccgctaaaaacctctttttctttacgcacccactatacctcgcctttctctcctctttaattccataattatattcgaaaata

SEQ ID NO: 40401 - DNA, 1140 bp, Artificial Sequence
  chemically treated genomic DNA (Homo sapiens) CpG-island No: 40401
gtatatcggtgttcgacggtaggagggtgtatattttttacgacggtgcgtcgcgatcggtttcggaacgattggtaaggttcgacgggtaaggtggttcggggggtttcgttagttcgttcgttcgttttttttttttttcgttttcgtttttcggtttcgcgttttttttcgggagggcgcgcgggtcggggcggcggcggcgacggcggtggcggcggcggcggcggcggcgggatcgaaatttttttcgagtgttatagttttttcggtagtagtattcgtcgaatttcggggtcgagggagcgagattcgtcgtcgcgtttttttttttttcggcgtttattttcgcggggaatttttcgcgaggggggtttttttcgcgggggcgcgtcggcgttttttcgtgggggggtcgggttattttttttacggcgcgatcgtttttttatttttttttttcgcgttttcgtttcggcgacggggggggtgtcgcgcgcgggtcggggggcggggcggattgtttttagtgcgtttcgggcgggtcgcgtcgtcgggttcgggggaggttttttcggggttacgcgcgcgtttttcgaagagggggacggcggagcgagcgtacggggtcggcggcgacgtcggttatttattcgattcgttttgaaatacggattaaggagtttaatacgtgcgcgagtcgggggttcgtacgaaagtcgtcgtggcgtaatgaaggtgaaggtcggcgcgttcgtcggtcgaggtgggatttcgaggtttttttagttcgtcgagggcgtattatcggttcgtttcgttcgtcgcgtcggggaggtggagtacgagcgtacgtgttaggattcgaaagatggtgaattatgtttgggtagggcgaagttagaggaaattttggtggaggttcgtagcggttttgacgtgtaaatcggtcgttcgatttgggtataggggcgaaagattaatcgaattatttagtagttggtttttttcgaagttttttttaggatagttggcgttttcgtagattcgacgtattttcgttacgtagttttattcggtaaagcgaatgattagaggttttggggtcgaaacgattttaatttatttttaaattttaaa

SEQ ID NO: 40402 - DNA, 1140 bp, Artificial Sequence
  chemically treated genomic DNA (Homo sapiens) CpG-island No: 40402
tttaaaatttaaaaataaattaaaatcgtttcgaccccaaaacctctaatcattcgctttaccgaataaaactacgtaacgaaaatacgtcgaatctacgaaaacgccaactatcctaaaaaaaacttcgaaaaaaaccaactactaaataattcgattaatctttcgcccctatacccaaatcgaacgaccgatttacacgtcaaaaccgctacgaacctccaccaaaatttcctctaacttcgccctacccaaacataattcaccatctttcgaatcctaacacgtacgctcgtactccacctccccgacgcgacgaacgaaacgaaccgataatacgccctcgacgaactaaaaaaacctcgaaatcccacctcgaccgacgaacgcgccgaccttcaccttcattacgccacgacgactttcgtacgaacccccgactcgcgcacgtattaaactccttaatccgtatttcaaaacgaatcgaataaataaccgacgtcgccgccgaccccgtacgctcgctccgccgtccccctcttcgaaaaacgcgcgcgtaaccccgaaaaaacctcccccgaacccgacgacgcgacccgcccgaaacgcactaaaaacaatccgccccgccccccgacccgcgcgcgacaccccccccgtcgccgaaacgaaaacgcgaaaaaaaaaaataaaaaaacgatcgcgccgtaaaaaaaataacccgacccccccacgaaaaaacgccgacgcgcccccgcgaaaaaaacccccctcgcgaaaaattccccgcgaaaataaacgccgaaaaaaaaaaaaacgcgacgacgaatctcgctccctcgaccccgaaattcgacgaatactactaccgaaaaaactataacactcgaaaaaaatttcgatcccgccgccgccgccgccgccgccaccgccgtcgccgccgccgccccgacccgcgcgccctcccgaaaaaaaacgcgaaaccgaaaaacgaaaacgaaaaaaaaaaaaaacgaacgaacgaactaacgaaaccccccgaaccaccttacccgtcgaaccttaccaatcgttccgaaaccgatcgcgacgcaccgtcgtaaaaaatatacaccctcctaccgtcgaacaccgatatac

SEQ ID NO: 40403 - DNA, 1140 bp, Artificial Sequence
  chemically treated genomic DNA (Homo sapiens) CpG-island No: 40403
tttaaagtttgagaataggttgagatcgtttcggttttaagatttttaattattcgttttatcggataaaattgcgtggcgggggtgcgtcgggtttgcgagagcgttagttattttgagggaaatttcggagggaattagttattagatggttcgattagtttttcgtttttatatttaggtcggacgatcgatttgtacgttaggatcgttacggatttttattagagttttttttggtttcgttttgtttaggtatagtttattatttttcgggttttaatacgtgcgttcgtgttttattttttcggcgcggcgggcgagacgggtcggtggtgcgttttcggcggattggagaggtttcgggattttatttcggtcggcgagcgcgtcggtttttatttttattgcgttacggcggttttcgtgcgagttttcgattcgcgtacgtgttagattttttggttcgtgttttaagacgggtcgggtgggtagtcgacgtcgtcgtcgatttcgtgcgttcgtttcgtcgttttttttttcgggggacgcgcgcgtggtttcgagagaatttttttcgggttcgacggcgcgattcgttcggggcgtattggggatagttcgtttcgtttttcgattcgcgcgcggtatttttttcgtcgtcggggcgggggcgcggggaggaggggtgggagagcggtcgcgtcgtgggaggggtggttcggtttttttacgaggagacgtcggcgcgttttcgcgggggagatttttttcgcgggggatttttcgcgggggtgggcgtcgggaggggggagagcgcggcgacgggtttcgttttttcggtttcgggattcggcgagtgttgttgtcgggggggttgtaatattcggggggggtttcggtttcgtcgtcgtcgtcgtcgtcgttatcgtcgtcgtcgtcgtcgtttcgattcgcgcgttttttcgagggaggacgcggggtcggggggcggagacgggggaggaggaggacggacggacggattgacggggtttttcgagttattttattcgtcggattttattagtcgtttcggagtcggtcgcggcgtatcgtcgtggaggatatgtatttttttgtcgtcggatatcggtatgt

SEQ ID NO: 40404 - DNA, 1140 bp, Artificial Sequence
  chemically treated genomic DNA (Homo sapiens) CpG-island No: 40404
acataccgatatccgacgacaaaaaaatacatatcctccacgacgatacgccgcgaccgactccgaaacgactaataaaatccgacgaataaaataactcgaaaaaccccgtcaatccgtccgtccgtcctcctcctcccccgtctccgccccccgaccccgcgtcctccctcgaaaaaacgcgcgaatcgaaacgacgacgacgacgacgataacgacgacgacgacgacgacgaaaccgaaaccccccccgaatattacaacccccccgacaacaacactcgccgaatcccgaaaccgaaaaaacgaaacccgtcgccgcgctctcccccctcccgacgcccacccccgcgaaaaatcccccgcgaaaaaaatctcccccgcgaaaacgcgccgacgtctcctcgtaaaaaaaccgaaccacccctcccacgacgcgaccgctctcccacccctcctccccgcgcccccgccccgacgacgaaaaaaataccgcgcgcgaatcgaaaaacgaaacgaactatccccaatacgccccgaacgaatcgcgccgtcgaacccgaaaaaaattctctcgaaaccacgcgcgcgtcccccgaaaaaaaaaacgacgaaacgaacgcacgaaatcgacgacgacgtcgactacccacccgacccgtcttaaaacacgaaccaaaaaatctaacacgtacgcgaatcgaaaactcgcacgaaaaccgccgtaacgcaataaaaataaaaaccgacgcgctcgccgaccgaaataaaatcccgaaacctctccaatccgccgaaaacgcaccaccgacccgtctcgcccgccgcgccgaaaaaataaaacacgaacgcacgtattaaaacccgaaaaataataaactatacctaaacaaaacgaaaccaaaaaaaactctaataaaaatccgtaacgatcctaacgtacaaatcgatcgtccgacctaaatataaaaacgaaaaactaatcgaaccatctaataactaattccctccgaaatttccctcaaaataactaacgctctcgcaaacccgacgcacccccgccacgcaattttatccgataaaacgaataattaaaaatcttaaaaccgaaacgatctcaacctattctcaaactttaaa

SEQ ID NO: 40405 - DNA, 501 bp, Artificial Sequence
  chemically treated genomic DNA (Homo sapiens) CpG-island No: 40405
  misc_feature (436)..(436): n is either a, c, g or t
atagacgtttttatttcgaagttcgttaaatttcgatattatatttttttatttttttatgtttcgtttcgtatataacgattaatagaatagattttttttttgtcgttatcgtagtaagcgttttagttatatgattttatttttacgaagatcgcgttcgacgcgattttttatttgacgatttatttttagagcgttttttcggatttgttgtcgtattaatatcgtttgtagtcgcgtttttatttcgatttttttcgcgttttcgttttttttttatgacggcgttgcgtttcgtcgattttatcgtaagattttcggtttttgttttcgtttttcgttttcgtatttttatttttttcggtcgttaattgttcgttattttttcgtgttcgtttttattcgtttacgtttttttcgcgcgcgtttttantttcgtttttttttatttcgatcgcgttttcgcggtttttttttcgttgttattttttattgatt

SEQ ID NO: 40406 - DNA, 501 bp, Artificial Sequence
  chemically treated genomic DNA (Homo sapiens) CpG-island No: 40406
  misc_feature (66)..(66): n is either a, c, g or t
aatcaataaaaaataacaacgaaaaaaaaaccgcgaaaacgcgatcgaaataaaaaaaaacgaaantaaaaacgcgcgcgaaaaaaacgtaaacgaataaaaacgaacacgaaaaaataacgaacaattaacgaccgaaaaaaataaaaatacgaaaacgaaaaacgaaaacaaaaaccgaaaatcttacgataaaatcgacgaaacgcaacgccgtcataaaaaaaaaacgaaaacgcgaaaaaaatcgaaataaaaacgcgactacaaacgatattaatacgacaacaaatccgaaaaaacgctctaaaaataaatcgtcaaataaaaaatcgcgtcgaacgcgatcttcgtaaaaataaaatcatataactaaaacgcttactacgataacgacaaaaaaaaaatctattctattaatcgttatatacgaaacgaaacataaaaaaataaaaaaatataatatcgaaatttaacgaacttcgaaataaaaacgtctat

SEQ ID NO: 40407 - DNA, 501 bp, Artificial Sequence
  chemically treated genomic DNA (Homo sapiens) CpG-island No: 40407
  misc_feature (66)..(66): n is either a, c, g or t
gattaatggaggatggtagcgaagggggaatcgcgggagcgcgatcgggataagggaagacggagntgggagcgcgcgcgaaaagggcgtggacgagtgggagcgaatacggagggatggcgggtaattgacggtcgagaagagtgggagtacgagggcgggaagcggggataaagatcgggggttttgcggtgagatcggcggggcgtaacgtcgttatggggggggagcgggaacgcggggggggtcgagataagaacgcgattataggcggtgttggtgcggtaatagattcgggggaacgttttgggagtgggtcgttaggtgaggggtcgcgtcgagcgcggttttcgtggaggtggagttatgtgattgaggcgtttgttacggtggcgatagggagaagatttattttgttggtcgttgtgtgcggggcggggtatggggggatgggagaatatggtgtcggaatttggcgagtttcggagtaggggcgtttat

SEQ ID NO: 40408 - DNA, 501 bp, Artificial Sequence
  chemically treated genomic DNA (Homo sapiens) CpG-island No: 40408
  misc_feature (436)..(436): n is either a, c, g or t
ataaacgcccctactccgaaactcgccaaattccgacaccatattctcccatccccccataccccgccccgcacacaacgaccaacaaaataaatcttctccctatcgccaccgtaacaaacgcctcaatcacataactccacctccacgaaaaccgcgctcgacgcgacccctcacctaacgacccactcccaaaacgttcccccgaatctattaccgcaccaacaccgcctataatcgcgttcttatctcgaccccccccgcgttcccgctccccccccataacgacgttacgccccgccgatctcaccgcaaaacccccgatctttatccccgcttcccgccctcgtactcccactcttctcgaccgtcaattacccgccatccctccgtattcgctcccactcgtccacgcccttttcgcgcgcgctcccanctccgtcttcccttatcccgatcgcgctcccgcgattcccccttcgctaccatcctccattaatc

SEQ ID NO: 40409 - DNA, 1289 bp, Artificial Sequence
  chemically treated genomic DNA (Homo sapiens) CpG-island No: 40409
  misc_feature (803)..(803): n is either a, c, g or t
ggggtcgcgtttgcgttagggggcggtttataattagattcgcggtttttaatttattttttagaggggcgaaagcgagtttcgataaggacggcgacggttttttagaagtcggggtttaggtaggttgttcggttttcgagttcgtttagcgtcgtttatgatgcgtttcgtagttttttttttaagaagggcgttcgggttttttttggacgcgtagttttcgcgcgtcgcggggtttgggaatagcgtatcggttgcgttcggagtcgggcggacggtgagattgacggcgttcgcgtttaatcgtggggcggggtcgagggggtttgtaggtagcgattaatgggagttcgtagagcgggcggggggcggtgtcgttgggcgggcgggcggtggtatcgggagtcggcgcggtagattgggagttcgggaggagttggcggagcgagaggaggaggaggacggaggaggagtatcgcgttttcgtcggtcgttcgagcgtaggtcgagagttttagtcgtagttagcgggttcgggtcgttttcgtcggagttcggcgcggggagagttcgggtcgatgggtagtttcgggtagcggcgggcggcgaggcggtagttcgggtacgcgtcgttcggcgcgtataggttgtagtaggtttcggcggtacggcgtgcgaaggttcgtgtcggggaattcgacgggtagcgtggcgagggtcggttcggaatgttgcggttaggcggggattgtttcgaaggggaaggggatgtttttcggggcgttttggggggttgacgncggcgaggggtgcgaggggcgcgggggtgcgagggtcgcggcgtagggttcggtttgtagacgtagatgcgttcgcgttttcgattttcggttggaagaggagtcgtcgtcgtttgttttttttaagttatcgatcggttgaaaggttattttcgtttcggcgatataggtattgaggagggttttttttaggtgtttagaatttcgttttgattaacgttttttggaagggttcgcggttgttcgacgtagttttttcggcgcgtttggttagttgacgtcgaatttgttgcggggttaattttttttttagagggggtgcgttcggagcgcgcgtttttatcgggacggatttttttttgtaagatcgggagttttcggcgagcgttttttttatttatcgcgatttttttttttattttgttagtttttgggttttttcgggttttttcgtgttagtgagggtagtttgtttacgttttggga

SEQ ID NO: 40410 - DNA, 1289 bp, Artificial Sequence
  chemically treated genomic DNA (Homo sapiens) CpG-island No: 40410
  misc_feature (487)..(487): n is either a, c, g or t
tcccaaaacgtaaacaaactaccctcactaacacgaaaaaacccgaaaaaacccaaaaactaacaaaataaaaaaaaaaatcgcgataaataaaaaaaacgctcgccgaaaactcccgatcttacaaaaaaaaatccgtcccgataaaaacgcgcgctccgaacgcaccccctctaaaaaaaaaattaaccccgcaacaaattcgacgtcaactaaccaaacgcgccgaaaaaactacgtcgaacaaccgcgaacccttccaaaaaacgttaatcaaaacgaaattctaaacacctaaaaaaaaccctcctcaatacctatatcgccgaaacgaaaataacctttcaaccgatcgataacttaaaaaaaacaaacgacgacgactcctcttccaaccgaaaatcgaaaacgcgaacgcatctacgtctacaaaccgaaccctacgccgcgaccctcgcacccccgcgcccctcgcacccctcgccgncgtcaaccccccaaaacgccccgaaaaacatccccttccccttcgaaacaatccccgcctaaccgcaacattccgaaccgaccctcgccacgctacccgtcgaattccccgacacgaaccttcgcacgccgtaccgccgaaacctactacaacctatacgcgccgaacgacgcgtacccgaactaccgcctcgccgcccgccgctacccgaaactacccatcgacccgaactctccccgcgccgaactccgacgaaaacgacccgaacccgctaactacgactaaaactctcgacctacgctcgaacgaccgacgaaaacgcgatactcctcctccgtcctcctcctcctctcgctccgccaactcctcccgaactcccaatctaccgcgccgactcccgataccaccgcccgcccgcccaacgacaccgccccccgcccgctctacgaactcccattaatcgctacctacaaaccccctcgaccccgccccacgattaaacgcgaacgccgtcaatctcaccgtccgcccgactccgaacgcaaccgatacgctattcccaaaccccgcgacgcgcgaaaactacgcgtccaaaaaaaacccgaacgcccttcttaaaaaaaaaactacgaaacgcatcataaacgacgctaaacgaactcgaaaaccgaacaacctacctaaaccccgacttctaaaaaaccgtcgccgtccttatcgaaactcgctttcgcccctctaaaaaataaattaaaaaccgcgaatctaattataaaccgccccctaacgcaaacgcgacccc

SEQ ID NO: 40411 - DNA, 1289 bp, Artificial Sequence
  chemically treated genomic DNA (Homo sapiens) CpG-island No: 40411
  misc_feature (487)..(487): n is either a, c, g or t
ttttaggacgtgggtaaattatttttattgatacgggaagattcggagaggtttaggagttggtaaagtgggaagaaaggtcgcggtgagtgagaagagcgttcgtcggaggttttcggttttataaagagggattcgtttcggtgagggcgcgcgtttcgggcgtattttttttagaaggggaattagtttcgtagtaagttcggcgttagttggttaggcgcgtcggggaagttgcgtcgggtaatcgcgagtttttttagagagcgttagttagagcgaagttttgggtatttggagaagattttttttagtgtttgtgtcgtcgagacgggaataattttttagtcgatcgataatttggagagaataggcggcggcggttttttttttagtcggggatcgggagcgcgggcgtatttgcgtttataagtcggattttgcgtcgcgattttcgtattttcgcgtttttcgtatttttcgtcgncgttagttttttaaagcgtttcgaagggtatttttttttttttcgggatagttttcgtttggtcgtagtatttcgaatcgattttcgttacgttgttcgtcggatttttcgatacgaattttcgtacgtcgtatcgtcggaatttgttatagtttgtgcgcgtcgggcggcgcgtattcgggttgtcgtttcgtcgttcgtcgttgttcggggttgtttatcggttcggatttttttcgcgtcgggtttcggcggaggcggttcggattcgttggttgcggttggagttttcggtttgcgttcgggcggtcggcgggggcgcggtgtttttttttcgtttttttttttttttcgtttcgttagtttttttcgggtttttagtttgtcgcgtcggttttcgatgttatcgttcgttcgtttagcggtatcgtttttcgttcgttttgcgggtttttattggtcgttgtttgtaggttttttcggtttcgttttacgattgggcgcggacgtcgttagttttatcgttcgttcggtttcgggcgtagtcggtgcgttgtttttaggtttcgcggcgcgcgggagttgcgcgtttaggaggggttcggacgttttttttggggagggggttgcggggcgtattatgagcggcgttgggcgagttcgagggtcgggtagtttatttggatttcggtttttagagagtcgtcgtcgtttttgtcgagattcgttttcgtttttttgaggaataagttaaaaatcgcgagtttggttatgagtcgttttttggcgtaggcgcgatttt

SEQ ID NO: 40412 - DNA, 1289 bp, Artificial Sequence
  chemically treated genomic DNA (Homo sapiens) CpG-island No: 40412
  misc_feature (803)..(803): n is either a, c, g or t
aaaatcgcgcctacgccaaaaaacgactcataaccaaactcgcgatttttaacttattcctcaaaaaaacgaaaacgaatctcgacaaaaacgacgacgactctctaaaaaccgaaatccaaataaactacccgaccctcgaactcgcccaacgccgctcataatacgccccgcaaccccctccccaaaaaaaacgtccgaacccctcctaaacgcgcaactcccgcgcgccgcgaaacctaaaaacaacgcaccgactacgcccgaaaccgaacgaacgataaaactaacgacgtccgcgcccaatcgtaaaacgaaaccgaaaaaacctacaaacaacgaccaataaaaacccgcaaaacgaacgaaaaacgataccgctaaacgaacgaacgataacatcgaaaaccgacgcgacaaactaaaaacccgaaaaaaactaacgaaacgaaaaaaaaaaaaaaacgaaaaaaaaacaccgcgcccccgccgaccgcccgaacgcaaaccgaaaactccaaccgcaaccaacgaatccgaaccgcctccgccgaaacccgacgcgaaaaaaatccgaaccgataaacaaccccgaacaacgacgaacgacgaaacgacaacccgaatacgcgccgcccgacgcgcacaaactataacaaattccgacgatacgacgtacgaaaattcgtatcgaaaaatccgacgaacaacgtaacgaaaatcgattcgaaatactacgaccaaacgaaaactatcccgaaaaaaaaaaaaatacccttcgaaacgctttaaaaaactaacgncgacgaaaaatacgaaaaacgcgaaaatacgaaaatcgcgacgcaaaatccgacttataaacgcaaatacgcccgcgctcccgatccccgactaaaaaaaaaaccgccgccgcctattctctccaaattatcgatcgactaaaaaattattcccgtctcgacgacacaaacactaaaaaaaatcttctccaaatacccaaaacttcgctctaactaacgctctctaaaaaaactcgcgattacccgacgcaacttccccgacgcgcctaaccaactaacgccgaacttactacgaaactaattccccttctaaaaaaaatacgcccgaaacgcgcgccctcaccgaaacgaatccctctttataaaaccgaaaacctccgacgaacgctcttctcactcaccgcgacctttcttcccactttaccaactcctaaacctctccgaatcttcccgtatcaataaaaataatttacccacgtcctaaaa

SEQ ID NO: 40413 - DNA, 509 bp, Artificial Sequence
  chemically treated genomic DNA (Homo sapiens) CpG-island No: 40413
tttaagagtcggtagtggatataaaatgagatacgtatataaatatacgcggggagggagtaattaatatatgcgttaataggcggtttcgttcgagtatcgttttcgcgggacgcggatgaggattgaaaattggatatttttatataggcgagaaaaagcgatgttgtttatagtttttttttattggagtcggtttttcggcgtattattttgtattattgtttagtttatcggagattttttggtggtatggagaacggtcggattgtagtatgtgtagacgtaaggttcgaagtataggttgagcgtgataaacggttcggcgacgtcggtttcgcggtcggatagcggacgtgattgagttgttagtttacgagtgttcgaggaagaataagtgaaggggttagtggtgtggagaagatacgtattcgtagtacggtggtttcgttttgtagttggtatttgttaatgtgtaggttgtatttgttgtacggtagaagcgagtt

SEQ ID NO: 40414 - DNA, 509 bp, Artificial Sequence
  chemically treated genomic DNA (Homo sapiens) CpG-island No: 40414
aactcgcttctaccgtacaacaaatacaacctacacattaacaaataccaactacaaaacgaaaccaccgtactacgaatacgtatcttctccacaccactaaccccttcacttattcttcctcgaacactcgtaaactaacaactcaatcacgtccgctatccgaccgcgaaaccgacgtcgccgaaccgtttatcacgctcaacctatacttcgaaccttacgtctacacatactacaatccgaccgttctccataccaccaaaaaatctccgataaactaaacaataatacaaaataatacgccgaaaaaccgactccaataaaaaaaaactataaacaacatcgctttttctcgcctatataaaaatatccaattttcaatcctcatccgcgtcccgcgaaaacgatactcgaacgaaaccgcctattaacgcatatattaattactccctccccgcgtatatttatatacgtatctcattttatatccactaccgactcttaaa

SEQ ID NO: 40415 - DNA, 509 bp, Artificial Sequence
  chemically treated genomic DNA (Homo sapiens) CpG-island No: 40415
aattcgtttttatcgtataatagatataatttatatattggtagatattaattataagacggggttatcgtgttacgggtacgtgttttttttatattattaatttttttatttattttttttcgaatattcgtggattaataatttagttacgttcgttgttcgatcgcggggtcgacgtcgtcgaatcgtttattacgtttaatttgtatttcgggttttgcgtttgtatatgttgtaattcggtcgttttttatattattagaaagttttcggtggattaggtagtggtatagggtgatacgtcgagagatcgattttaataggaagggattgtggataatatcgttttttttcgtttgtatgggaatatttagtttttagtttttattcgcgtttcgcgaagacggtattcgagcggagtcgtttattgacgtatgtgttaattatttttttttcgcgtgtgtttatatgcgtattttattttatgtttattgtcggtttttgga

SEQ ID NO: 40416 - DNA, 509 bp, Artificial Sequence
  chemically treated genomic DNA (Homo sapiens) CpG-island No: 40416
tccaaaaaccgacaataaacataaaataaaatacgcatataaacacacgcgaaaaaaaaataattaacacatacgtcaataaacgactccgctcgaataccgtcttcgcgaaacgcgaataaaaactaaaaactaaatattcccatacaaacgaaaaaaaacgatattatccacaatcccttcctattaaaatcgatctctcgacgtatcaccctataccactacctaatccaccgaaaactttctaataatataaaaaacgaccgaattacaacatatacaaacgcaaaacccgaaatacaaattaaacgtaataaacgattcgacgacgtcgaccccgcgatcgaacaacgaacgtaactaaattattaatccacgaatattcgaaaaaaaataaataaaaaaattaataatataaaaaaaacacgtacccgtaacacgataaccccgtcttataattaatatctaccaatatataaattatatctattatacgataaaaacgaatt

SEQ ID NO: 40417 - DNA, 704 bp, Artificial Sequence
  chemically treated genomic DNA (Homo sapiens) CpG-island No: 40417
tttcgttgcgttcgttcggtcgtaggtcggcggttcgggtttcgcgtcgttagttcgttcggtcgtttgcgtcgcgcgtcgcggttttttttttcgttatttgataacgggtcgtcgtcggtcgtcgtagtcgtagcggtggtcgggtcgtgcgcgtcggtgtacgtcgtttattagtaagtaggtatatttttgtttttagcgttttcgcgcggttttttttttttaggatattacgtaaagtagtttttttttatttgtatagattcgcggttagggtatttttcgtatttttttacgcgttcgatatttttttcgcggttttttttattttcgtttttttcgatttttattttcgggttatcgggaaggggttgggggtatacgtcggggagcgggggacggagttcggcggcggcgattttaatataaagtgaaataagtttttagcgtcgaaggaggtaggaaaaatttagcgtttaggttatttatcgagtcgaggagggatttagattttcgtcgtttcgttttcgcggtggtcggttcgtttttcgcgtatttcgaggttgtatttagtattttagacgcgagacgtggaggaacgttgtgaacgagtcgggagattttttaagttgttttgggtttcgtggagcgttaaggtttaagatataatttggtaaagatttgtgttatagttatcgaag

SEQ ID NO: 40418 - DNA, 704 bp, Artificial Sequence
  chemically treated genomic DNA (Homo sapiens) CpG-island No: 40418
cttcgataactataacacaaatctttaccaaattatatcttaaaccttaacgctccacgaaacccaaaacaacttaaaaaatctcccgactcgttcacaacgttcctccacgtctcgcgtctaaaatactaaatacaacctcgaaatacgcgaaaaacgaaccgaccaccgcgaaaacgaaacgacgaaaatctaaatccctcctcgactcgataaataacctaaacgctaaatttttcctacctccttcgacgctaaaaacttatttcactttatattaaaatcgccgccgccgaactccgtcccccgctccccgacgtatacccccaaccccttcccgataacccgaaaataaaaatcgaaaaaaacgaaaataaaaaaaaccgcgaaaaaaatatcgaacgcgtaaaaaaatacgaaaaataccctaaccgcgaatctatacaaataaaaaaaaactactttacgtaatatcctaaaaaaaaaaaaccgcgcgaaaacgctaaaaacaaaaatatacctacttactaataaacgacgtacaccgacgcgcacgacccgaccaccgctacgactacgacgaccgacgacgacccgttatcaaataacgaaaaaaaaaaccgcgacgcgcgacgcaaacgaccgaacgaactaacgacgcgaaacccgaaccgccgacctacgaccgaacgaacgcaacgaaa

SEQ ID NO: 40419 - DNA, 704 bp, Artificial Sequence
  chemically treated genomic DNA (Homo sapiens) CpG-island No: 40419
tttcggtgattgtggtataagtttttgttaagttgtgttttggattttgacgttttacggagtttagagtaatttggagggtttttcggttcgtttatagcgtttttttacgtttcgcgtttggggtgttgggtgtagtttcggggtgcgcggagggcggatcggttatcgcgagagcggagcggcgggaatttaggttttttttcggttcggtaagtggtttggacgttgggttttttttgtttttttcggcgttgggagtttgttttattttatattggaatcgtcgtcgtcgaatttcgtttttcgtttttcggcgtgtgtttttagttttttttcggtggttcgagggtgagggtcggagggggcggggatgggggagatcgcgggaggggtgtcgggcgcgtggggaaatgcggggaatattttggtcgcggatttatgtagatgaggggaggttgttttgcgtaatgttttggggggagggggtcgcgcgggagcgttggaggtaggaatgtgtttgtttattaatgagcgacgtgtatcggcgcgtacggttcggttatcgttgcggttgcggcggtcggcggcggttcgttgttaggtagcgggggagggggtcgcggcgcgcggcgtaggcggtcgggcgggttggcggcgcgaggttcgggtcgtcggtttgcggtcgagcgagcgtagcgaag

SEQ ID NO: 40420 - DNA, 704 bp, Artificial Sequence
  chemically treated genomic DNA (Homo sapiens) CpG-island No: 40420
cttcgctacgctcgctcgaccgcaaaccgacgacccgaacctcgcgccgccaacccgcccgaccgcctacgccgcgcgccgcgaccccctcccccgctacctaacaacgaaccgccgccgaccgccgcaaccgcaacgataaccgaaccgtacgcgccgatacacgtcgctcattaataaacaaacacattcctacctccaacgctcccgcgcgaccccctccccccaaaacattacgcaaaacaacctcccctcatctacataaatccgcgaccaaaatattccccgcatttccccacgcgcccgacacccctcccgcgatctcccccatccccgccccctccgaccctcaccctcgaaccaccgaaaaaaaactaaaaacacacgccgaaaaacgaaaaacgaaattcgacgacgacgattccaatataaaataaaacaaactcccaacgccgaaaaaaacaaaaaaaacccaacgtccaaaccacttaccgaaccgaaaaaaaacctaaattcccgccgctccgctctcgcgataaccgatccgccctccgcgcaccccgaaactacacccaacaccccaaacgcgaaacgtaaaaaaacgctataaacgaaccgaaaaaccctccaaattactctaaactccgtaaaacgtcaaaatccaaaacacaacttaacaaaaacttataccacaatcaccgaaa

SEQ ID NO: 40421 - DNA, 636 bp, Artificial Sequence
  chemically treated genomic DNA (Homo sapiens) CpG-island No: 40421
tgcgttacgtgtcgcgttttatgagaggggcgaagatttagggcgcgggggggggtgatttcggaaacgggagttttttgcgtaatatgttagaggttacggggtcgtattggtggggggaaatcgttggcgggcgaggaaacgggaaataaatggcggtgttaatgataggatgaggtggggaatattagtatagtggcggggatttgaggtattcgtaatatagtttttttgagcggtttattcggtgtgttagtttatcgacgtggaattatcggtaatcggtagcggtatttcgacgggttatgagcgatgcgattacgatatcgttgatcggggcggcgacggtcggggggtaaagcgcggcgcgaaatgtgggcgcgggtatgcggggcggcgataaggacgtcggggtggcgtcgcggttttttggtttttgtgttacggggatatgatgcgattcggtttagggggacgtggttttttcgttcgcgggggtttatatacgtcgcggaggttgggtaggagacgatggatttttgcgttcgcgagtaataggcgggatatataaatcgcgttattttttttttttttatgttttcgtaaagtaagatttatttttttttcgttaagtta

SEQ ID NO: 40422 - DNA, 636 bp, Artificial Sequence
  chemically treated genomic DNA (Homo sapiens) CpG-island No: 40422
taacttaacgaaaaaaaaataaatcttactttacgaaaacataaaaaaaaaaaaaataacgcgatttatatatcccgcctattactcgcgaacgcaaaaatccatcgtctcctacccaacctccgcgacgtatataaacccccgcgaacgaaaaaaccacgtccccctaaaccgaatcgcatcatatccccgtaacacaaaaaccaaaaaaccgcgacgccaccccgacgtccttatcgccgccccgcatacccgcgcccacatttcgcgccgcgctttaccccccgaccgtcgccgccccgatcaacgatatcgtaatcgcatcgctcataacccgtcgaaataccgctaccgattaccgataattccacgtcgataaactaacacaccgaataaaccgctcaaaaaaactatattacgaatacctcaaatccccgccactatactaatattccccacctcatcctatcattaacaccgccatttatttcccgtttcctcgcccgccaacgatttccccccaccaatacgaccccgtaacctctaacatattacgcaaaaaactcccgtttccgaaatcacccccccccgcgccctaaatcttcgcccctctcataaaacgcgacacgtaacgca

SEQ ID NO: 40423 - DNA, 636 bp, Artificial Sequence
  chemically treated genomic DNA (Homo sapiens) CpG-island No: 40423
tggtttggcgaaaagaaaatggattttattttacgaagatataaaaagggggggggtgacgcggtttatatgtttcgtttgttattcgcgggcgtagggatttatcgttttttatttagttttcgcgacgtgtgtaaattttcgcgagcgggggggttacgtttttttgagtcgggtcgtattatgttttcgtgatatagagattaagagatcgcggcgttatttcggcgtttttgtcgtcgtttcgtatattcgcgtttatatttcgcgtcgcgttttgtttttcggtcgtcgtcgtttcgattaacggtatcgtaatcgtatcgtttatgattcgtcgaagtgtcgttgtcggttgtcgatagttttacgtcgataagttgatatatcgagtaggtcgtttagaagagttgtattacgagtattttaggttttcgttattgtgttaatattttttattttattttgttattaatatcgttatttatttttcgttttttcgttcgttaacggtttttttttattagtgcgatttcgtgatttttagtatgttgcgtaaaaaattttcgttttcgggattattttttttcgcgttttagattttcgttttttttatagggcgcggtacgtgacgta

SEQ ID NO: 40424 - DNA, 636 bp, Artificial Sequence
  chemically treated genomic DNA (Homo sapiens) CpG-island No: 40424
tacgtcacgtaccgcgccctataaaaaaaacgaaaatctaaaacgcgaaaaaaaataatcccgaaaacgaaaattttttacgcaacatactaaaaatcacgaaatcgcactaataaaaaaaaaccgttaacgaacgaaaaaacgaaaaataaataacgatattaataacaaaataaaataaaaaatattaacacaataacgaaaacctaaaatactcgtaatacaactcttctaaacgacctactcgatatatcaacttatcgacgtaaaactatcgacaaccgacaacgacacttcgacgaatcataaacgatacgattacgataccgttaatcgaaacgacgacgaccgaaaaacaaaacgcgacgcgaaatataaacgcgaatatacgaaacgacgacaaaaacgccgaaataacgccgcgatctcttaatctctatatcacgaaaacataatacgacccgactcaaaaaaacgtaacccccccgctcgcgaaaatttacacacgtcgcgaaaactaaataaaaaacgataaatccctacgcccgcgaataacaaacgaaacatataaaccgcgtcaccccccccctttttatatcttcgtaaaataaaatccattttcttttcgccaaacca

SEQ ID NO: 40425 - DNA, 1174 bp, Artificial Sequence
  chemically treated genomic DNA (Homo sapiens) CpG-island No: 40425
aatttggcgagggcgttgcgggtttcgagcgttttggttaaggtcggttttttagtcgcgcgtttattttgtcggggcgaggcgcgcgcggtggttagggcggcgtcgttcggcgcgcggttgaggttgtagttgttgagtcgttgtgtagcgcgaatttgtagacgttgcggtcgcgcgtcgtgtagttgaagaggtagtagtcgagtacggttgtcgggggcgcggggcgtcggggtagttttattacggttacggagtagcgcggttcggagtagtaggtcgttacgtattgtcgttagtttcgtacggtcgtcggcgttcgtaggaagttggtattcgtcgttagggagtttttggtgcggatgatggcgttaggtattgcgttgtagtcgtcgttgttcgggttcgggtagtttttttgggggtcgtcgttcgcgcgtagttttagttttagttttttttgaggtcgtttttgttgtagttgtcggcggaatttttttagtagttgttttacgttcgatagttgcgcgtgtagttcggatagcggcgtcgcgggcggtaaggtcgtacggtcgtttggtagttataggtagagtagtagtagttcgcgtagcgtttcgtgacgcggcggtagtcggcgttgcgagttcgcgtttttttgggcgacggaggttatggcgacgagagttaagggtagcgagtcgaggcggggttgagcgcgggaggaaggcggggacgcgggcgagcgcgggttttgggttttttttgcgcggtcgcggttggttttaggtttcggttttatagcgcggcgttttcgaattcggttgttttttcgaggtcgcgggcgtcggcgggaatcgtagtagcgggagatatagtcggtttagtcgggtatcgttttttgttttcgtcggagattgtttagcgttttgcgttttttcgtttcggtttgcggcgcgttgggtggcgacgagtcggtttcggcgttgattagtattaggtgtgtgcgaatagtggtcgcggcggggtggagttttggtgagtttcgttttttcgcgcggtttcgttttcgcgcgtttcgcgtcggtttttttagggttgggagagtaggtttcggggagggtagttttagaataattttgttttcgcgtcgttgtttagttagggtagg

SEQ ID NO: 40426 - DNA, 1174 bp, Artificial Sequence
  chemically treated genomic DNA (Homo sapiens) CpG-island No: 40426
cctaccctaactaaacaacgacgcgaaaacaaaattattctaaaactaccctccccgaaacctactctcccaaccctaaaaaaaccgacgcgaaacgcgcgaaaacgaaaccgcgcgaaaaaacgaaactcaccaaaactccaccccgccgcgaccactattcgcacacacctaatactaatcaacgccgaaaccgactcgtcgccacccaacgcgccgcaaaccgaaacgaaaaaacgcaaaacgctaaacaatctccgacgaaaacaaaaaacgatacccgactaaaccgactatatctcccgctactacgattcccgccgacgcccgcgacctcgaaaaaacaaccgaattcgaaaacgccgcgctataaaaccgaaacctaaaaccaaccgcgaccgcgcaaaaaaaacccaaaacccgcgctcgcccgcgtccccgccttcctcccgcgctcaaccccgcctcgactcgctacccttaactctcgtcgccataacctccgtcgcccaaaaaaacgcgaactcgcaacgccgactaccgccgcgtcacgaaacgctacgcgaactactactactctacctataactaccaaacgaccgtacgaccttaccgcccgcgacgccgctatccgaactacacgcgcaactatcgaacgtaaaacaactactaaaaaaattccgccgacaactacaacaaaaacgacctcaaaaaaaactaaaactaaaactacgcgcgaacgacgacccccaaaaaaactacccgaacccgaacaacgacgactacaacgcaatacctaacgccatcatccgcaccaaaaactccctaacgacgaataccaacttcctacgaacgccgacgaccgtacgaaactaacgacaatacgtaacgacctactactccgaaccgcgctactccgtaaccgtaataaaactaccccgacgccccgcgcccccgacaaccgtactcgactactacctcttcaactacacgacgcgcgaccgcaacgtctacaaattcgcgctacacaacgactcaacaactacaacctcaaccgcgcgccgaacgacgccgccctaaccaccgcgcgcgcctcgccccgacaaaataaacgcgcgactaaaaaaccgaccttaaccaaaacgctcgaaacccgcaacgccctcgccaaatt

SEQ ID NO: 40427 - DNA, 1174 bp, Artificial Sequence
  chemically treated genomic DNA (Homo sapiens) CpG-island No: 40427
tttgttttagttgggtagcggcgcgggagtaaagttgttttgaggttgtttttttcggggtttgtttttttagttttggaggagtcggcgcgagacgcgcgggggcggggtcgcgcgggggggcggggtttattaaggttttatttcgtcgcggttattgttcgtatatatttggtgttgattaacgtcgaggtcgattcgtcgttatttagcgcgtcgtaggtcggggcggagaggcgtagggcgttgggtagttttcggcgagggtaaggagcggtgttcggttgggtcggttatgtttttcgttattgcggttttcgtcggcgttcgcgatttcgggggagtagtcgggttcgggggcgtcgcgttgtgaggtcggggtttagagttagtcgcggtcgcgtaggaggggtttagggttcgcgttcgttcgcgttttcgtttttttttcgcgtttagtttcgtttcggttcgttgtttttggttttcgtcgttatggttttcgtcgtttaggagagcgcgggttcgtagcgtcggttatcgtcgcgttacggggcgttgcgcgggttgttattgttttgtttgtggttgttaagcggtcgtgcggttttgtcgttcgcggcgtcgttgttcgaattgtacgcgtagttgtcgggcgtggagtagttgttggaggagtttcgtcggtaattgtagtaggagcggttttaggaggagttggagttggagttgcgcgcgggcggcggtttttaggaggattgttcgggttcgggtagcggcggttatagcgtaatgtttgacgttattattcgtattaaggattttttggcggcgggtgttagttttttgcgggcgtcggcggtcgtgcggggttggcggtaatgcgtggcggtttgttgtttcgagtcgcgttgtttcgtggtcgtggtggagttgtttcggcgtttcgcgttttcggtagtcgtgttcggttgttatttttttaattgtacggcgcgcggtcgtaacgtttgtaagttcgcgttgtatagcggtttagtagttatagttttagtcgcgcgtcggacggcgtcgttttggttatcgcgcgcgtttcgtttcggtagggtaagcgcgcgattgaggggtcggttttggttagagcgttcgagattcgtagcgttttcgttaagtt

SEQ ID NO: 40428 - DNA, 1174 bp, Artificial Sequence
  chemically treated genomic DNA (Homo sapiens) CpG-island No: 40428
aacttaacgaaaacgctacgaatctcgaacgctctaaccaaaaccgacccctcaatcgcgcgcttaccctaccgaaacgaaacgcgcgcgataaccaaaacgacgccgtccgacgcgcgactaaaactataactactaaaccgctatacaacgcgaacttacaaacgttacgaccgcgcgccgtacaattaaaaaaataacaaccgaacacgactaccgaaaacgcgaaacgccgaaacaactccaccacgaccacgaaacaacgcgactcgaaacaacaaaccgccacgcattaccgccaaccccgcacgaccgccgacgcccgcaaaaaactaacacccgccgccaaaaaatccttaatacgaataataacgtcaaacattacgctataaccgccgctacccgaacccgaacaatcctcctaaaaaccgccgcccgcgcgcaactccaactccaactcctcctaaaaccgctcctactacaattaccgacgaaactcctccaacaactactccacgcccgacaactacgcgtacaattcgaacaacgacgccgcgaacgacaaaaccgcacgaccgcttaacaaccacaaacaaaacaataacaacccgcgcaacgccccgtaacgcgacgataaccgacgctacgaacccgcgctctcctaaacgacgaaaaccataacgacgaaaaccaaaaacaacgaaccgaaacgaaactaaacgcgaaaaaaaaacgaaaacgcgaacgaacgcgaaccctaaacccctcctacgcgaccgcgactaactctaaaccccgacctcacaacgcgacgcccccgaacccgactactcccccgaaatcgcgaacgccgacgaaaaccgcaataacgaaaaacataaccgacccaaccgaacaccgctccttaccctcgccgaaaactacccaacgccctacgcctctccgccccgacctacgacgcgctaaataacgacgaatcgacctcgacgttaatcaacaccaaatatatacgaacaataaccgcgacgaaataaaaccttaataaaccccgcccccccgcgcgaccccgcccccgcgcgtctcgcgccgactcctccaaaactaaaaaaacaaaccccgaaaaaaacaacctcaaaacaactttactcccgcgccgctacccaactaaaacaaa

SEQ ID NO: 40429 - DNA, 735 bp, Artificial Sequence
  chemically treated genomic DNA (Homo sapiens) CpG-island No: 40429
  misc_feature (334)..(334): n is either a, c, g or t
  misc_feature (342)..(342): n is either a, c, g or t
atttagaacgtggtcgtttcgtagaacgacggggttttaaatggatttggcggtcgcgtttcgttggtatttcggttttgattgtcgtttttcggtttttatcgtagcgtcgagttgggtcgtcgatttacgtatttggttgtttgaggtaggtcgtacgtagttttaaattggttcgggttatttgggttatagtcgcggttttcgggagaaagcgttttttagtttcggaatagttaattttcggttttagttaggtatgagtttttaggcgagttttttaaatttaaggcggagtttcgtgcgttaattatcggtgggagatagggagggnggcgtgtntattttcgtttttcgttttcgttggtttcgaaagcggagtgcgaagtttttttaaatttaatcggcggcggagcggcggtgagggggcgtgtttgttcgggttttgtttatcgtttttttcgttttcgcgcggcgttcgaggcgttttttttattgacgttagtttttagggttagcgcggttttgttggcgcgggagttgggcggggttgtatttttgttttagggtgcggcgaaagttggttttgtcgggtatacgtgacggatgtttttttttttgggttcgaggttagcgcgcgcggtattgattgttttgtagcgcgtggttttttgtagatttttagattttgtcgtttaagtttttttttagtttatcgtttggtttcggttttga

SEQ ID NO: 40430 - DNA, 735 bp, Artificial Sequence
  chemically treated genomic DNA (Homo sapiens) CpG-island No: 40430
  misc_feature (394)..(394): n is either a, c, g or t
  misc_feature (402)..(402): n is either a, c, g or t
tcaaaaccgaaaccaaacgataaactaaaaaaaaacttaaacgacaaaatctaaaaatctacaaaaaaccacgcgctacaaaacaatcaataccgcgcgcgctaacctcgaacccaaaaaaaaaaacatccgtcacgtatacccgacaaaaccaactttcgccgcaccctaaaacaaaaatacaaccccgcccaactcccgcgccaacaaaaccgcgctaaccctaaaaactaacgtcaataaaaaaaacgcctcgaacgccgcgcgaaaacgaaaaaaacgataaacaaaacccgaacaaacacgccccctcaccgccgctccgccgccgattaaatttaaaaaaacttcgcactccgctttcgaaaccaacgaaaacgaaaaacgaaaatanacacgccnccctccctatctcccaccgataattaacgcacgaaactccgccttaaatttaaaaaactcgcctaaaaactcatacctaactaaaaccgaaaattaactattccgaaactaaaaaacgctttctcccgaaaaccgcgactataacccaaataacccgaaccaatttaaaactacgtacgacctacctcaaacaaccaaatacgtaaatcgacgacccaactcgacgctacgataaaaaccgaaaaacgacaatcaaaaccgaaataccaacgaaacgcgaccgccaaatccatttaaaaccccgtcgttctacgaaacgaccacgttctaaat

SEQ ID NO: 40431 - DNA, 735 bp, Artificial Sequence
  chemically treated genomic DNA (Homo sapiens) CpG-island No: 40431
  misc_feature (394)..(394): n is either a, c, g or t
  misc_feature (402)..(402): n is either a, c, g or t
ttaaagtcggagttaaacggtgggttgggaggggatttgagcggtagagtttgaggatttgtagagggttacgcgttgtaaggtagttagtgtcgcgcgcgttggtttcgggtttaggagaaggggtattcgttacgtgtattcggtagggttagttttcgtcgtattttggggtaggaatgtagtttcgtttagttttcgcgttagtaaaatcgcgttggttttggggattgacgttaatgaagggggcgtttcgggcgtcgcgcgggggcggagagggcggtgggtagggttcgggtagatacgtttttttatcgtcgtttcgtcgtcgattaggtttgaggaagtttcgtatttcgttttcgaggttagcggaggcggggggcggggatgnatacgttnttttttttgttttttatcgatgattggcgtacggaatttcgttttgggtttggaaggttcgtttgggagtttatatttggttagggtcgaggattggttgtttcggggttagggagcgttttttttcgggaatcgcggttgtgatttaagtggttcggattagtttggggttgcgtgcggtttgttttaagtaattaggtacgtaggtcggcggtttagttcggcgttgcggtgggagtcggagggcgatagttagagtcggggtgttagcgggacgcgatcgttagatttatttaggatttcgtcgttttgcgaagcggttacgttttgagt

SEQ ID NO: 40432 - DNA, 735 bp, Artificial Sequence
  chemically treated genomic DNA (Homo sapiens) CpG-island No: 40432
  misc_feature (334)..(334): n is either a, c, g or t
  misc_feature (342)..(342): n is either a, c, g or t
actcaaaacgtaaccgcttcgcaaaacgacgaaatcctaaataaatctaacgatcgcgtcccgctaacaccccgactctaactatcgccctccgactcccaccgcaacgccgaactaaaccgccgacctacgtacctaattacttaaaacaaaccgcacgcaaccccaaactaatccgaaccacttaaatcacaaccgcgattcccgaaaaaaaacgctccctaaccccgaaacaaccaatcctcgaccctaaccaaatataaactcccaaacgaaccttccaaacccaaaacgaaattccgtacgccaatcatcgataaaaaacaaaaaaaanaacgtatncatccccgccccccgcctccgctaacctcgaaaacgaaatacgaaacttcctcaaacctaatcgacgacgaaacgacgataaaaaaacgtatctacccgaaccctacccaccgccctctccgcccccgcgcgacgcccgaaacgcccccttcattaacgtcaatccccaaaaccaacgcgattttactaacgcgaaaactaaacgaaactacattcctaccccaaaatacgacgaaaactaaccctaccgaatacacgtaacgaataccccttctcctaaacccgaaaccaacgcgcgcgacactaactaccttacaacgcgtaaccctctacaaatcctcaaactctaccgctcaaatcccctcccaacccaccgtttaactccgactttaa

SEQ ID NO: 40433 - DNA, 789 bp, Artificial Sequence
  chemically treated genomic DNA (Homo sapiens) CpG-island No: 40433
cggcggcggtttttattttcgtatttattttttgagggtttttgacgaagtagttttcgttggagttttggtagatgcgttcgggaaagatgtagcgttcgatggttagttcggtttgtcgtattatcgtttcgaatttaggatttttcgggaattcgtttcgttcgcggtgggtttgagcggcgtgggttgtcgtcgcggtttgagcggttagagtttgggtttgcgtcgttacggtttgggtttggttttgggtcgtcgcgtttcgggttcgatttaatagtggttgtcgttcgcggtcgtggttcggcgagttcggcggagaggggttcgagtcggtcgtcgtcgttattcggatcgcgttttcgggtatttgcggaaagtgagcgttcgagttcgacgggaaggtgtagttcgggggttgggttcgttcgggggatattagtgggttcgtttcgtttattttttagatagtcggtttcgggattcggcgcgttttatattattgcgttcgcggtcgcgattaattcgtgatattttttaggtttcggtcggttaattaggtcgcgacgtttttttggtttcgtttttaatttgttttgtttatttggttacgaataggtacggtttttcgcgcgcgaatagtagttaattagaatttgtttttacgtaatcgttgttttcgtattttttttttcgttattttttgtgaagattgcgtatgttttaggatttaattttgggttaggtacgttttttgtttttattatattagcgttacgtttagtt

SEQ ID NO: 40434 - DNA, 789 bp, Artificial Sequence
  chemically treated genomic DNA (Homo sapiens) CpG-island No: 40434
aactaaacgtaacgctaatataataaaaacaaaaaacgtacctaacccaaaattaaatcctaaaacatacgcaatcttcacaaaaaataacgaaaaaaaaaatacgaaaacaacgattacgtaaaaacaaattctaattaactactattcgcgcgcgaaaaaccgtacctattcgtaaccaaataaacaaaacaaattaaaaacgaaaccaaaaaaacgtcgcgacctaattaaccgaccgaaacctaaaaaatatcacgaattaatcgcgaccgcgaacgcaataatataaaacgcgccgaatcccgaaaccgactatctaaaaaataaacgaaacgaacccactaatatcccccgaacgaacccaacccccgaactacaccttcccgtcgaactcgaacgctcactttccgcaaatacccgaaaacgcgatccgaataacgacgacgaccgactcgaacccctctccgccgaactcgccgaaccacgaccgcgaacgacaaccactattaaatcgaacccgaaacgcgacgacccaaaaccaaacccaaaccgtaacgacgcaaacccaaactctaaccgctcaaaccgcgacgacaacccacgccgctcaaacccaccgcgaacgaaacgaattcccgaaaaatcctaaattcgaaacgataatacgacaaaccgaactaaccatcgaacgctacatctttcccgaacgcatctaccaaaactccaacgaaaactacttcgtcaaaaaccctcaaaaaataaatacgaaaataaaaaccgccgccg

SEQ ID NO: 40435 - DNA, 789 bp, Artificial Sequence
  chemically treated genomic DNA (Homo sapiens) CpG-island No: 40435
agttaagcgtggcgttggtatagtaggggtagggggcgtgtttgatttaaggttgggttttggagtatgcgtagtttttatagaaggtgacggggagaaaaatgcggaggtagcgattgcgtaggagtaggttttgattggttattgttcgcgcgcgaggggtcgtgtttattcgtagttaagtaaatagggtaggttagaggcggggttaaggaggcgtcgcgatttggttggtcggtcggggtttgggggatgttacggattggtcgcggtcgcgagcgtagtggtgtggagcgcgtcgggtttcggagtcggttgtttgagggatggacgagacgagtttattagtgtttttcgagcgggtttaattttcggattatattttttcgtcgggttcgggcgtttatttttcgtaggtgttcgggggcgcggttcgagtggcggcggcggtcggttcgggttttttttcgtcgggttcgtcgggttacgatcgcgagcggtagttattgttggatcgggttcggggcgcggcggtttagggttagatttaaatcgtggcggcgtaggtttaggttttggtcgtttaggtcgcggcggtagtttacgtcgtttaggtttatcgcgagcggaacgagttttcggaggattttgagttcgaggcggtggtgcggtaggtcgagttggttatcgagcgttgtatttttttcgagcgtatttattagggttttagcggaagttatttcgttaaggatttttagggggtgagtgcgggggtggggatcgtcgtcg

SEQ ID NO: 40436 - DNA, 789 bp, Artificial Sequence
  chemically treated genomic DNA (Homo sapiens) CpG-island No: 40436
cgacgacgatccccacccccgcactcaccccctaaaaatccttaacgaaataacttccgctaaaaccctaataaatacgctcgaaaaaaatacaacgctcgataaccaactcgacctaccgcaccaccgcctcgaactcaaaatcctccgaaaactcgttccgctcgcgataaacctaaacgacgtaaactaccgccgcgacctaaacgaccaaaacctaaacctacgccgccacgatttaaatctaaccctaaaccgccgcgccccgaacccgatccaacaataactaccgctcgcgatcgtaacccgacgaacccgacgaaaaaaaacccgaaccgaccgccgccgccactcgaaccgcgcccccgaacacctacgaaaaataaacgcccgaacccgacgaaaaaatataatccgaaaattaaacccgctcgaaaaacactaataaactcgtctcgtccatccctcaaacaaccgactccgaaacccgacgcgctccacaccactacgctcgcgaccgcgaccaatccgtaacatcccccaaaccccgaccgaccaaccaaatcgcgacgcctccttaaccccgcctctaacctaccctatttacttaactacgaataaacacgacccctcgcgcgcgaacaataaccaatcaaaacctactcctacgcaatcgctacctccgcatttttctccccgtcaccttctataaaaactacgcatactccaaaacccaaccttaaatcaaacacgccccctacccctactataccaacgccacgcttaact

SEQ ID NO: 40437 - DNA, 556 bp, Artificial Sequence
  chemically treated genomic DNA (Homo sapiens) CpG-island No: 40437
gaggtttcgtttcggggcggttcgtttgcgagtgtgtgttagtttttcggatcgtagtttgcgtttgtttcgggagacggcgcgttcggcgcggcggtcgggattttgggttgggattttgggcggcggcggcgttgtcgtcgggcgggagttgagcgttagggttttcgggcgcgggcgatagtggaaacgttggagggtagggagagggtgttagggcgtattcgcgcggggcggcggcgggggaagggattaaggaggttggttttcggggattttttcgtttcgatcggggtcgcggcgggcgcgggcggttttacgttattttttgtttgttttggtagcgacgttcgtagttatagagcgtcgaaagtaggtagaggtcgtggtagacgtcgtcgtagacggcggtcgttaggaaggcgtggtaggcgtaggggagcgggtaatttttgaggttgtagtagttgtggcgttgtatttggtcgtttatgatgtcggtggcggcgtcgtagagcgcggtcgttagtatatcgtgcgttacgttgattatgag

SEQ ID NO: 40438 - DNA, 556 bp, Artificial Sequence
  chemically treated genomic DNA (Homo sapiens) CpG-island No: 40438
ctcataatcaacgtaacgcacgatatactaacgaccgcgctctacgacgccgccaccgacatcataaacgaccaaatacaacgccacaactactacaacctcaaaaattacccgctcccctacgcctaccacgccttcctaacgaccgccgtctacgacgacgtctaccacgacctctacctactttcgacgctctataactacgaacgtcgctaccaaaacaaacaaaaaataacgtaaaaccgcccgcgcccgccgcgaccccgatcgaaacgaaaaaatccccgaaaaccaacctccttaatcccttcccccgccgccgccccgcgcgaatacgccctaacaccctctccctaccctccaacgtttccactatcgcccgcgcccgaaaaccctaacgctcaactcccgcccgacgacaacgccgccgccgcccaaaatcccaacccaaaatcccgaccgccgcgccgaacgcgccgtctcccgaaacaaacgcaaactacgatccgaaaaactaacacacactcgcaaacgaaccgccccgaaacgaaacctc

SEQ ID NO: 40439 - DNA, 556 bp, Artificial Sequence
  chemically treated genomic DNA (Homo sapiens) CpG-island No: 40439
tttatggttaacgtggcgtacgatgtgttggcggtcgcgttttacggcgtcgttatcggtattatgagcgattagatgtagcgttatagttattgtaattttaaggattattcgtttttttgcgtttattacgtttttttggcggtcgtcgtttgcggcggcgtttgttacggtttttatttgttttcggcgttttatggttgcgggcgtcgttgttagggtaagtaggaggtggcgtgaggtcgttcgcgttcgtcgcggtttcgatcggggcgggggaattttcggagattagtttttttaattttttttttcgtcgtcgtttcgcgcgggtgcgttttggtattttttttttgttttttagcgtttttattgtcgttcgcgttcgggaattttgacgtttagttttcgttcgacggtagcgtcgtcgtcgtttagaattttagtttagaatttcgatcgtcgcgtcggacgcgtcgtttttcgggataagcgtaggttgcgattcgaggggttgatatatattcgtagacgagtcgtttcgaggcgaaatttt

SEQ ID NO: 40440 - DNA, 556 bp, Artificial Sequence
  chemically treated genomic DNA (Homo sapiens) CpG-island No: 40440
aaaatttcgcctcgaaacgactcgtctacgaatatatatcaacccctcgaatcgcaacctacgcttatcccgaaaaacgacgcgtccgacgcgacgatcgaaattctaaactaaaattctaaacgacgacgacgctaccgtcgaacgaaaactaaacgtcaaaattcccgaacgcgaacgacaataaaaacgctaaaaaacaaaaaaaaaataccaaaacgcacccgcgcgaaacgacgacgaaaaaaaaaattaaaaaaactaatctccgaaaattcccccgccccgatcgaaaccgcgacgaacgcgaacgacctcacgccacctcctacttaccctaacaacgacgcccgcaaccataaaacgccgaaaacaaataaaaaccgtaacaaacgccgccgcaaacgacgaccgccaaaaaaacgtaataaacgcaaaaaaacgaataatccttaaaattacaataactataacgctacatctaatcgctcataataccgataacgacgccgtaaaacgcgaccgccaacacatcgtacgccacgttaaccataaa

SEQ ID NO: 40441 - DNA, 890 bp, Artificial Sequence
  chemically treated genomic DNA (Homo sapiens) CpG-island No: 40441
acgttttagggtagcgacgtcggttttattttagttacggttgttttaagtttttcggggtttttcgtcggttttattcgagttataagtttataggatttttcggagtttttcgtcgggacgtaagatttatcgttagaggttggtattttttagagaatagcgaagcgtatttcgagggtcgtcggtcggaagcgttttttagattcgttttttgtttttcggagtcggaagttgggtatttgtagttggttcggcgtattttattgatcgtttcgacgatgttacgcgcgttcggttgtttttttcggattttcgtagcgtttgtcgcggttttggttgcggcgttgttttcgtcgtttgcgcgttgtttttttttagagtcgagggattcggtggtttcgtcgtttagtttttatttcggtattaagattcgttacgaggatgttaatttcgtgttattgtcgggtttcgaggtttcgtggcgggattttgagttgttggaggggatttgtatttcggtgtagttggtcgtttttattcgttacggtattcgttattttacggttaaatagattcgtaagttgaggtagttgtacgggttgttgtaggttcgcgggtttagggatggcggggttagtagtatcggtagtcgcgatttgggtgtagcgttggtcgattggtttttgtggtacgcggattggatggacgggtagttagtagagaagggacggtaggatatgcgatagttggcgttgcgtttggtttcgtttttttcggttttttttagtcgtgagaattacggtcgtttgcggtttattattagttttaagtatcgttgtatggatagtagcgtcgtttttttgtaggggttgtggtagtattattat

SEQ ID NO: 40442 - DNA, 890 bp, Artificial Sequence
  chemically treated genomic DNA (Homo sapiens) CpG-island No: 40442
ataataatactaccacaacccctacaaaaaaacgacgctactatccatacaacgatacttaaaactaataataaaccgcaaacgaccgtaattctcacgactaaaaaaaaccgaaaaaaacgaaaccaaacgcaacgccaactatcgcatatcctaccgtcccttctctactaactacccgtccatccaatccgcgtaccacaaaaaccaatcgaccaacgctacacccaaatcgcgactaccgatactactaaccccgccatccctaaacccgcgaacctacaacaacccgtacaactacctcaacttacgaatctatttaaccgtaaaataacgaataccgtaacgaataaaaacgaccaactacaccgaaatacaaatcccctccaacaactcaaaatcccgccacgaaacctcgaaacccgacaataacacgaaattaacatcctcgtaacgaatcttaataccgaaataaaaactaaacgacgaaaccaccgaatccctcgactctaaaaaaaaacaacgcgcaaacgacgaaaacaacgccgcaaccaaaaccgcgacaaacgctacgaaaatccgaaaaaaacaaccgaacgcgcgtaacatcgtcgaaacgatcaataaaatacgccgaaccaactacaaatacccaacttccgactccgaaaaacaaaaaacgaatctaaaaaacgcttccgaccgacgaccctcgaaatacgcttcgctattctctaaaaaataccaacctctaacgataaatcttacgtcccgacgaaaaactccgaaaaatcctataaacttataactcgaataaaaccgacgaaaaaccccgaaaaacttaaaacaaccgtaactaaaataaaaccgacgtcgctaccctaaaacgt

SEQ ID NO: 40443 - DNA, 890 bp, Artificial Sequence
  chemically treated genomic DNA (Homo sapiens) CpG-island No: 40443
gtggtagtgttgttatagtttttgtaggaaggcggcgttgttatttatgtagcggtgtttggaattggtgatgagtcgtaggcggtcgtagtttttacggttgaaaagggtcgggaagagcgaggttagacgtagcgttagttgtcgtatattttgtcgttttttttttattagttgttcgtttatttagttcgcgtattataaaggttagtcggttagcgttgtatttaggtcgcggttgtcggtattattagtttcgttatttttggattcgcgggtttgtagtaattcgtgtagttgttttagtttgcggatttgtttgatcgtggggtagcgggtgtcgtggcgaatgagggcgattagttgtatcggggtgtaggttttttttagtagtttagggtttcgttacggagtttcggggttcgataatagtacggggttgatattttcgtagcgagttttggtgtcgaaataggggttgagcgacgaggttatcgggtttttcggttttagaagagagtagcgcgtaagcgacgagagtagcgtcgtagttagggtcgcggtaggcgttacggaggttcggaggaggtagtcgggcgcgcgtagtatcgtcgggacggttagtggagtgcgtcgagttagttgtagatgtttagttttcggtttcggagggtagggggcgggtttggagggcgttttcggtcggcggttttcgggatgcgtttcgttgttttttaggaggtattaatttttggcggtgggttttgcgtttcggcggaaagtttcgaggagttttgtagatttgtggttcgggtggagtcggcggaaaatttcgagaagtttgagatagtcgtggttgaggtggagtcggcgtcgttgttttggagcgt

SEQ ID NO: 40444 - DNA, 890 bp, Artificial Sequence
  chemically treated genomic DNA (Homo sapiens) CpG-island No: 40444
acgctccaaaacaacgacgccgactccacctcaaccacgactatctcaaacttctcgaaattttccgccgactccacccgaaccacaaatctacaaaactcctcgaaactttccgccgaaacgcaaaacccaccgccaaaaattaatacctcctaaaaaacaacgaaacgcatcccgaaaaccgccgaccgaaaacgccctccaaacccgccccctaccctccgaaaccgaaaactaaacatctacaactaactcgacgcactccactaaccgtcccgacgatactacgcgcgcccgactacctcctccgaacctccgtaacgcctaccgcgaccctaactacgacgctactctcgtcgcttacgcgctactctcttctaaaaccgaaaaacccgataacctcgtcgctcaacccctatttcgacaccaaaactcgctacgaaaatatcaaccccgtactattatcgaaccccgaaactccgtaacgaaaccctaaactactaaaaaaaacctacaccccgatacaactaatcgccctcattcgccacgacacccgctaccccacgatcaaacaaatccgcaaactaaaacaactacacgaattactacaaacccgcgaatccaaaaataacgaaactaataataccgacaaccgcgacctaaatacaacgctaaccgactaacctttataatacgcgaactaaataaacgaacaactaataaaaaaaaaacgacaaaatatacgacaactaacgctacgtctaacctcgctcttcccgacccttttcaaccgtaaaaactacgaccgcctacgactcatcaccaattccaaacaccgctacataaataacaacgccgccttcctacaaaaactataacaacactaccac

SEQ ID NO: 40445 - DNA, 554 bp, Artificial Sequence
  chemically treated genomic DNA (Homo sapiens) CpG-island No: 40445
gaattcgaggcgtttgcgtttttttcgtagggatttttacgttttatcgggtggggtttacgcggtcgtcgggagggggtaggaaatgtaatcgttcgcgagacgtagagttaaaaatttaaatgatcgcgggttttttcgtcgtttggggtttttcgcgtttttttcgattttacgtacgcgcgcgtgtttcgggaagttatcggggatagtgcgtagggcgtggtttgtttcgtcgggggttcggatcggtttttgcgttcgtagttttcggtagtcgtttagggaaggtcgtttttttcgcgaggtttgggtaggcgggaagggttttaggtcgcgcgcggtttcgcgtttgggagttttttttcggggtcgggttggggagcggttttacggtttttggattttgttttgtcgagaagtgttgggtataggagcgagtagtcggtttagcgggttagggcgtttttacgagagttttttgggaagtttttttttggaaaaattattaaggcggattgatttcgattagagagaaaaggggtttttgggaa

SEQ ID NO: 40446 - DNA, 554 bp, Artificial Sequence
  chemically treated genomic DNA (Homo sapiens) CpG-island No: 40446
ttcccaaaaaccccttttctctctaatcgaaatcaatccgccttaataatttttccaaaaaaaaacttcccaaaaaactctcgtaaaaacgccctaacccgctaaaccgactactcgctcctatacccaacacttctcgacaaaacaaaatccaaaaaccgtaaaaccgctccccaacccgaccccgaaaaaaaactcccaaacgcgaaaccgcgcgcgacctaaaacccttcccgcctacccaaacctcgcgaaaaaaacgaccttccctaaacgactaccgaaaactacgaacgcaaaaaccgatccgaacccccgacgaaacaaaccacgccctacgcactatccccgataacttcccgaaacacgcgcgcgtacgtaaaatcgaaaaaaacgcgaaaaaccccaaacgacgaaaaaacccgcgatcatttaaatttttaactctacgtctcgcgaacgattacatttcctaccccctcccgacgaccgcgtaaaccccacccgataaaacgtaaaaatccctacgaaaaaaacgcaaacgcctcgaattc

SEQ ID NO: 40447 - DNA, 554 bp, Artificial Sequence
  chemically treated genomic DNA (Homo sapiens) CpG-island No: 40447
tttttaggagttttttttttttttaatcgggattagttcgttttaatgatttttttaggaagaaattttttaggaggttttcgtaaaaacgttttggttcgttaagtcggttgttcgtttttgtgtttagtatttttcggtagggtaggatttagggatcgtgaagtcgttttttagttcggtttcgaaagggaatttttaagcgcggggtcgcgcgcggtttagggtttttttcgtttgtttaggtttcgcgaggggagcggttttttttaggcggttgtcgggagttgcgggcgtagaagtcgattcgggttttcggcgggataggttacgttttgcgtattgttttcggtggtttttcggggtacgcgcgcgtgcgtggggtcggggggggcgcgggggattttaggcggcgaggggattcgcggttatttgggtttttggttttgcgtttcgcggacggttgtattttttgttttttttcggcggtcgcgtgggttttattcggtggagcgtgggggtttttgcgggagggacgtaggcgtttcgggttt

SEQ ID NO: 40448 - DNA, 554 bp, Artificial Sequence
  chemically treated genomic DNA (Homo sapiens) CpG-island No: 40448
aaacccgaaacgcctacgtccctcccgcaaaaacccccacgctccaccgaataaaacccacgcgaccgccgaaaaaaaacaaaaaatacaaccgtccgcgaaacgcaaaaccaaaaacccaaataaccgcgaatcccctcgccgcctaaaatcccccgcgccccccccgaccccacgcacgcgcgcgtaccccgaaaaaccaccgaaaacaatacgcaaaacgtaacctatcccgccgaaaacccgaatcgacttctacgcccgcaactcccgacaaccgcctaaaaaaaaccgctcccctcgcgaaacctaaacaaacgaaaaaaaccctaaaccgcgcgcgaccccgcgcttaaaaattccctttcgaaaccgaactaaaaaacgacttcacgatccctaaatcctaccctaccgaaaaatactaaacacaaaaacgaacaaccgacttaacgaaccaaaacgtttttacgaaaacctcctaaaaaatttcttcctaaaaaaatcattaaaacgaactaatcccgattaaaaaaaaaaaaaactcctaaaaa

SEQ ID NO: 40449 - DNA, 549 bp, Artificial Sequence
  chemically treated genomic DNA (Homo sapiens) CpG-island No: 40449
tttttcgttattcgtcgtcgcgttttttcgattttgggttaaggatgtttcgagtcgtttcgttgtttcgatttgcgtcgtatttggtgagtagtgtcggagtagggataacgtttggttcgcgggtagcgcgggtcgttcgcgtttttttttttcgtttcggtcgtcgacgtcgcgggcgttcgtcgtcgcgttcgcgcgttttttcgtcgcggttttttgtcggcgtcgcgcgttcggtatcggttttcgggggcgcgtacgttcgttttcgtttcggcgtcggtcgcgcgttttatagtttacgttttttattttcgtttatatgcgtcgtcgtagtttcgtttcgattcgcgcggcgattgttttttttttcgtcgttttcgcgtttttcgattttagggatcgtagtcgagtttcgtttttaggtatacgcggaggacgttcgttcgttcgcgcgttttcggagcgattttttttatttattattatgttttatttaagttttttttataataaataaaggtatagttttattaatttgtataa

SEQ ID NO: 40450 - DNA, 549 bp, Artificial Sequence
  chemically treated genomic DNA (Homo sapiens) CpG-island No: 40450
ttatacaaattaataaaactatacctttatttattataaaaaaaacttaaataaaacataataataaataaaaaaaatcgctccgaaaacgcgcgaacgaacgaacgtcctccgcgtatacctaaaaacgaaactcgactacgatccctaaaatcgaaaaacgcgaaaacgacgaaaaaaaaaacaatcgccgcgcgaatcgaaacgaaactacgacgacgcatataaacgaaaataaaaaacgtaaactataaaacgcgcgaccgacgccgaaacgaaaacgaacgtacgcgcccccgaaaaccgataccgaacgcgcgacgccgacaaaaaaccgcgacgaaaaaacgcgcgaacgcgacgacgaacgcccgcgacgtcgacgaccgaaacgaaaaaaaaaaacgcgaacgacccgcgctacccgcgaaccaaacgttatccctactccgacactactcaccaaatacgacgcaaatcgaaacaacgaaacgactcgaaacatccttaacccaaaatcgaaaaaacgcgacgacgaataacgaaaaa

SEQ ID NO: 40451 - DNA, 549 bp, Artificial Sequence
  chemically treated genomic DNA (Homo sapiens) CpG-island No: 40451
ttgtgtaaattgatagagttgtatttttatttgttgtgggaggggtttgggtggggtatggtggtgggtggggggggtcgtttcgggggcgcgcgggcggacgggcgtttttcgcgtgtgtttgggggcgaggttcggttgcgatttttgggatcggggggcgcggggacgacggaggggggggtagtcgtcgcgcgggtcgaggcggggttgcggcggcgtatgtggacgggggtggggggcgtgggttgtggggcgcgcggtcggcgtcggggcgggggcgggcgtgcgcgttttcgggggtcggtgtcgggcgcgcggcgtcggtagggggtcgcggcgggggggcgcgcgggcgcggcggcgggcgttcgcggcgtcggcggtcggggcggggggggggggcgcggacggttcgcgttgttcgcgagttagacgttgtttttatttcggtattgtttattaggtgcggcgtaggtcgagatagcggagcggttcgaggtatttttggtttaggatcggaggggcgcggcggcgggtggcggggga

SEQ ID NO: 40452 - DNA, 549 bp, Artificial Sequence
  chemically treated genomic DNA (Homo sapiens) CpG-island No: 40452
tcccccgccacccgccgccgcgcccctccgatcctaaaccaaaaatacctcgaaccgctccgctatctcgacctacgccgcacctaataaacaataccgaaataaaaacaacgtctaactcgcgaacaacgcgaaccgtccgcgccccccccccccgccccgaccgccgacgccgcgaacgcccgccgccgcgcccgcgcgcccccccgccgcgaccccctaccgacgccgcgcgcccgacaccgacccccgaaaacgcgcacgcccgcccccgccccgacgccgaccgcgcgccccacaacccacgccccccacccccgtccacatacgccgccgcaaccccgcctcgacccgcgcgacgactacccccccctccgtcgtccccgcgccccccgatcccaaaaatcgcaaccgaacctcgcccccaaacacacgcgaaaaacgcccgtccgcccgcgcgcccccgaaacgaccccccccacccaccaccataccccacccaaacccctcccacaacaaataaaaatacaactctatcaatttacacaa

SEQ ID NO: 40453 - DNA, 502 bp, Artificial Sequence
  chemically treated genomic DNA (Homo sapiens) CpG-island No: 40453
cgcgtgatgtcgcggggtggttcggggcggtgatttcgtcgaagtggcgggttcgttttcggtgttttcggtttcggttgtttttatttcgtttcgtacgcgtttcgtttacggaaatgaattttatatttcggtaatttcggcgtcggtacggcgtataagcgaagagtttaattagagttttagtttcggtagttaggacggtcgcggtcgagcgattcgtttagtcggttttttattagtcgcgttcggcggtcgggggggtgcgacgtaagggttggttttgattcgtatttgtttgtacgagggagtcgatcgtttagtagtggttagagagtatgtgacgtttcgtttattcgtttttgtgttacgtgggtttcgtgacgtcgtttattcggttacggtttaaaagtagaggtatacgggttgcgttcggtggacgggtatttgtggggaaacggcgtggtcgggcgggcgagggcgggttttggttatcggggtt

SEQ ID NO: 40454 - DNA, 502 bp, Artificial Sequence
  chemically treated genomic DNA (Homo sapiens) CpG-island No: 40454
aaccccgataaccaaaacccgccctcgcccgcccgaccacgccgtttccccacaaatacccgtccaccgaacgcaacccgtatacctctacttttaaaccgtaaccgaataaacgacgtcacgaaacccacgtaacacaaaaacgaataaacgaaacgtcacatactctctaaccactactaaacgatcgactccctcgtacaaacaaatacgaatcaaaaccaacccttacgtcgcacccccccgaccgccgaacgcgactaataaaaaaccgactaaacgaatcgctcgaccgcgaccgtcctaactaccgaaactaaaactctaattaaactcttcgcttatacgccgtaccgacgccgaaattaccgaaatataaaattcatttccgtaaacgaaacgcgtacgaaacgaaataaaaacaaccgaaaccgaaaacaccgaaaacgaacccgccacttcgacgaaatcaccgccccgaaccaccccgcgacatcacgcg

SEQ ID NO: 40455 - DNA, 502 bp, Artificial Sequence
  chemically treated genomic DNA (Homo sapiens) CpG-island No: 40455
gatttcggtgattagggttcgttttcgttcgttcggttacgtcgtttttttatagatgttcgtttatcggacgtagttcgtgtgtttttgtttttggatcgtggtcgggtaaacggcgttacgggatttacgtgatatagggacgaatgaacgaaacgttatatgttttttggttattgttaggcggtcggttttttcgtgtaagtagatacgaattaaggttaatttttacgtcgtattttttcgatcgtcgggcgcggttggtggaggatcggttaagcgggtcgttcggtcgcggtcgttttagttgtcgaggttggggttttggttggatttttcgtttgtacgtcgtatcggcgtcgggattgtcgaggtgtgagatttattttcgtgggcggagcgcgtgcgggacgggataagggtagtcggggtcggagatatcggagacggattcgttatttcggcggggttatcgtttcggattatttcgcggtattacgcg

SEQ ID NO: 40456 - DNA, 502 bp, Artificial Sequence
  chemically treated genomic DNA (Homo sapiens) CpG-island No: 40456
cgcgtaataccgcgaaataatccgaaacgataaccccgccgaaataacgaatccgtctccgatatctccgaccccgactacccttatcccgtcccgcacgcgctccgcccacgaaaataaatctcacacctcgacaatcccgacgccgatacgacgtacaaacgaaaaatccaaccaaaaccccaacctcgacaactaaaacgaccgcgaccgaacgacccgcttaaccgatcctccaccaaccgcgcccgacgatcgaaaaaatacgacgtaaaaattaaccttaattcgtatctacttacacgaaaaaaccgaccgcctaacaataaccaaaaaacatataacgtttcgttcattcgtccctatatcacgtaaatcccgtaacgccgtttacccgaccacgatccaaaaacaaaaacacacgaactacgtccgataaacgaacatctataaaaaaacgacgtaaccgaacgaacgaaaacgaaccctaatcaccgaaatc

SEQ ID NO: 40457 - DNA, 642 bp, Artificial Sequence
  chemically treated genomic DNA (Homo sapiens) CpG-island No: 40457
acggaagcggtcgattaagtttttcgtttcggtttcggtttcggtttcgatttttattaagatttcggtttcggtttcggtttcggattcgtttcgagttttatgtagtttgcgttgtatttggtgaagaagttcgcgaagtcgttatttcgtcgagttcgggtcgaagttttcgtaggattttgtttcgcggcgggtaagggtatcggcggtttcgtcgggggtaggtgatcgcgggcgttttgatcgcggtttatttggaacgtgttgcgagagttgaagtgaatgttagaaaagtttaggcgcggtttcgtatttttattagttttttcggtcgaggtggtagggggcgcgtttttttcgggattttcggcgtcgatttttcgttgttttgagttttcgttattgttgtagttgttggcggggttgtttttcgagtcgttgttcgcgttttcgggtttttgggcgttcgcggttattaggtagtagtttcgtagcgggtttttaagcggagaggtttaatcggacgggtttttcgcgtcgttcgcgttttcgtcgttaggtttttttaggcgaaggcggtcgtaggggcggcggcggcgcgattttcggtcgtcggcgcgcgttagttcgcgagttttt

SEQ ID NO: 40458 - DNA, 642 bp, Artificial Sequence
  chemically treated genomic DNA (Homo sapiens) CpG-island No: 40458
aaaaactcgcgaactaacgcgcgccgacgaccgaaaatcgcgccgccgccgcccctacgaccgccttcgcctaaaaaaacctaacgacgaaaacgcgaacgacgcgaaaaacccgtccgattaaacctctccgcttaaaaacccgctacgaaactactacctaataaccgcgaacgcccaaaaacccgaaaacgcgaacaacgactcgaaaaacaaccccgccaacaactacaacaataacgaaaactcaaaacaacgaaaaatcgacgccgaaaatcccgaaaaaaacgcgccccctaccacctcgaccgaaaaaactaataaaaatacgaaaccgcgcctaaacttttctaacattcacttcaactctcgcaacacgttccaaataaaccgcgatcaaaacgcccgcgatcacctacccccgacgaaaccgccgatacccttacccgccgcgaaacaaaatcctacgaaaacttcgacccgaactcgacgaaataacgacttcgcgaacttcttcaccaaatacaacgcaaactacataaaactcgaaacgaatccgaaaccgaaaccgaaaccgaaatcttaataaaaatcgaaaccgaaaccgaaaccgaaacgaaaaacttaatcgaccgcttccgt

SEQ ID NO: 40459 - DNA, 642 bp, Artificial Sequence
  chemically treated genomic DNA (Homo sapiens) CpG-island No: 40459
agaggttcgcgggttggcgcgcgtcggcggtcgggagtcgcgtcgtcgtcgtttttacggtcgttttcgtttggaggggtttggcgacgaggacgcggacggcgcgggaagttcgttcgattgggttttttcgtttgaggattcgttgcggagttgttgtttggtggtcgcggacgtttaggagttcgagggcgcgggtagcgattcgggggatagtttcgttagtagttgtagtagtagcgaggatttagagtagcggggagtcggcgtcgggggtttcgaggagggcgcgttttttgttatttcggtcgagaggattaatgggggtgcggagtcgcgtttgggtttttttgatatttattttaattttcgtaatacgttttaggtgagtcgcggttagagcgttcgcgattatttgttttcggcggggtcgtcggtgtttttgttcgtcgcggagtagggttttgcgggggtttcggttcgggttcgacggagtggcggtttcgcggatttttttattaggtatagcgtaggttgtatgggattcggggcgggttcggggtcggggtcggagtcggggttttggtgggagtcggagtcggagtcggagtcggagcggagagtttggtcggtcgttttcgt

SEQ ID NO: 40460 - DNA, 642 bp, Artificial Sequence
  chemically treated genomic DNA (Homo sapiens) CpG-island No: 40460
acgaaaacgaccgaccaaactctccgctccgactccgactccgactccgactcccaccaaaaccccgactccgaccccgaccccgaacccgccccgaatcccatacaacctacgctatacctaataaaaaaatccgcgaaaccgccactccgtcgaacccgaaccgaaacccccgcaaaaccctactccgcgacgaacaaaaacaccgacgaccccgccgaaaacaaataatcgcgaacgctctaaccgcgactcacctaaaacgtattacgaaaattaaaataaatatcaaaaaaacccaaacgcgactccgcacccccattaatcctctcgaccgaaataacaaaaaacgcgccctcctcgaaacccccgacgccgactccccgctactctaaatcctcgctactactacaactactaacgaaactatcccccgaatcgctacccgcgccctcgaactcctaaacgtccgcgaccaccaaacaacaactccgcaacgaatcctcaaacgaaaaaacccaatcgaacgaacttcccgcgccgtccgcgtcctcgtcgccaaacccctccaaacgaaaacgaccgtaaaaacgacgacgacgcgactcccgaccgccgacgcgcgccaacccgcgaacctct

SEQ ID NO: 40461 - DNA, 626 bp, Artificial Sequence
  chemically treated genomic DNA (Homo sapiens) CpG-island No: 40461
gcgggggtcgtcggcgagattgagttcgggatagtttagagttttagcgttttagcgttttgtagttcgtttagagcgcgtagattatttttatgtttcgttcgtttttttgttatattcgtttttagttcggtttcgtcgtttttttatttcgtcgggattattgtagttttggcggtagcgcgcggatatgttttcggggcgtattcgtcgagtcgcgtttttgcgtagtggttttttttcgggttttaggttgcgcgattcgcgtttcggtggggcggggagcggattgggcggaggcgtcggcgaggttggggtcgggggtttagttggtaacgtcgggagagggaagcgtagcgcggaaaattttagtgttcggttttcgaaatgtatcggtttatttagtttcgttagtttcgtcggggattttgtttggtcggtaaagaggatttagcgcggggattcgttttaagtattgtggtttggttaggggcgaggggcgtagcggaggagggacgtttcgcggttatgtaatgtatcggttttttgtgtttttagttaaatcgttttaggattgtcggatttttttcgggaagagttatgatttttgatttcggtaagtcgag

SEQ ID NO: 40462 - DNA, 626 bp, Artificial Sequence
  chemically treated genomic DNA (Homo sapiens) CpG-island No: 40462
ctcgacttaccgaaatcaaaaatcataactcttcccgaaaaaaatccgacaatcctaaaacgatttaactaaaaacacaaaaaaccgatacattacataaccgcgaaacgtccctcctccgctacgcccctcgcccctaaccaaaccacaatacttaaaacgaatccccgcgctaaatcctctttaccgaccaaacaaaatccccgacgaaactaacgaaactaaataaaccgatacatttcgaaaaccgaacactaaaattttccgcgctacgcttccctctcccgacgttaccaactaaacccccgaccccaacctcgccgacgcctccgcccaatccgctccccgccccaccgaaacgcgaatcgcgcaacctaaaacccgaaaaaaaaccactacgcaaaaacgcgactcgacgaatacgccccgaaaacatatccgcgcgctaccgccaaaactacaataatcccgacgaaataaaaaaacgacgaaaccgaactaaaaacgaatataacaaaaaaacgaacgaaacataaaaataatctacgcgctctaaacgaactacaaaacgctaaaacgctaaaactctaaactatcccgaactcaatctcgccgacgacccccgc

SEQ ID NO: 40463 - DNA, 626 bp, Artificial Sequence
  chemically treated genomic DNA (Homo sapiens) CpG-island No: 40463
ttcggtttgtcgaggttaggggttatggtttttttcggggagggttcggtagttttagagcggtttggttggggatatagaaagtcggtgtattatataatcgcgagacgtttttttttcgttgcgtttttcgtttttagttaagttatagtatttagagcggattttcgcgttaaattttttttgtcggttaggtagagttttcggcggagttggcggggttgaatgagtcggtgtatttcgaaggtcgagtattgggatttttcgcgttacgtttttttttttcggcgttgttagttaggttttcggttttagtttcgtcggcgttttcgtttagttcgtttttcgttttatcgaagcgcggatcgcgtagtttggggttcgggaaggggttattgcgtagggacgcggttcggcgggtgcgtttcgggggtatgttcgcgcgttatcgttagggttgtagtggtttcggcgaggtgaggaggcggcggggtcgggttgggggcgggtgtggtaggagggcgggcggggtatgggggtggtttgcgcgttttgggcgggttgtagagcgttggagcgttggagttttgggttgtttcgggtttagtttcgtcggcggttttcgt

SEQ ID NO: 40464 - DNA, 626 bp, Artificial Sequence
  chemically treated genomic DNA (Homo sapiens) CpG-island No: 40464
acgaaaaccgccgacgaaactaaacccgaaacaacccaaaactccaacgctccaacgctctacaacccgcccaaaacgcgcaaaccacccccataccccgcccgccctcctaccacacccgcccccaacccgaccccgccgcctcctcacctcgccgaaaccactacaaccctaacgataacgcgcgaacatacccccgaaacgcacccgccgaaccgcgtccctacgcaataaccccttcccgaaccccaaactacgcgatccgcgcttcgataaaacgaaaaacgaactaaacgaaaacgccgacgaaactaaaaccgaaaacctaactaacaacgccgaaaaaaaaaaacgtaacgcgaaaaatcccaatactcgaccttcgaaatacaccgactcattcaaccccgccaactccgccgaaaactctacctaaccgacaaaaaaaatttaacgcgaaaatccgctctaaatactataacttaactaaaaacgaaaaacgcaacgaaaaaaaaacgtctcgcgattatataatacaccgactttctatatccccaaccaaaccgctctaaaactaccgaaccctccccgaaaaaaaccataacccctaacctcgacaaaccgaa

SEQ ID NO: 40465 - DNA, 505 bp, Artificial Sequence
  chemically treated genomic DNA (Homo sapiens) CpG-island No: 40465
tatttcgtttttttttttttttttttttcgtcgtttttttttttgtttttttttttttttttttcggtcgtcgtttttttttttttcgcgtttttcgttcgttttcgttcggtattttttttatttatttttttatttttatggcgtttttttttcgtttttcgcgtttcgtattcgtttcgattttttatttattttcgttggtttgttgtttgttcgtttgtcgataattttcgtaggtggtcgtgcggggttggttcgttcgtagtaatgggagtggaaaggttgcgtgtttcgtttgttaagtggcggagaggggggggtgtgagggtgtggagcggcggtcgttcgtttttcggtcgggggtcgttatatgtcgtttttttttttttatttttcgtgcgattattaaggacgcggacggcgcgtatttttttttttttttttggtgtaggggtttttttttaggttgatggatttagtgggttcgaagggtgggggggtt

SEQ ID NO: 40466 - DNA, 505 bp, Artificial Sequence
  chemically treated genomic DNA (Homo sapiens) CpG-island No: 40466
aacccccccacccttcgaacccactaaatccatcaacctaaaaaaaaacccctacaccaaaaaaaaaaaaaaaaatacgcgccgtccgcgtccttaataatcgcacgaaaaataaaaaaaaaaaaacgacatataacgacccccgaccgaaaaacgaacgaccgccgctccacaccctcacacccccccctctccgccacttaacaaacgaaacacgcaacctttccactcccattactacgaacgaaccaaccccgcacgaccacctacgaaaattatcgacaaacgaacaaacaacaaaccaacgaaaataaataaaaaatcgaaacgaatacgaaacgcgaaaaacgaaaaaaaaacgccataaaaataaaaaaataaataaaaaaaataccgaacgaaaacgaacgaaaaacgcgaaaaaaaaaaaaacgacgaccgaaaaaaaaaaaaaaaaaaacaaaaaaaaaaacgacgaaaaaaaaaaaaaaaaaaaaacgaaata

SEQ ID NO: 40467 - DNA, 505 bp, Artificial Sequence
  chemically treated genomic DNA (Homo sapiens) CpG-island No: 40467
ggtttttttatttttcgagtttattaaatttattagtttggggaagagtttttgtattaagaaaaggagagaagatacgcgtcgttcgcgtttttagtggtcgtacgagaagtgggggggagggggcgatatataacgattttcgatcgaaggacgaacggtcgtcgttttatatttttatattttttttttttcgttatttaataaacgaaatacgtaatttttttatttttattgttgcgggcgggttagtttcgtacgattatttacgaaaattgtcggtagacgagtaggtaataggttagcgagagtgaatagaaggtcggagcggatgcgggacgcgagagacgggaagggagcgttatgggagtggaggggtggatggaggagatgtcgggcggagacggacgagggacgcgggaagagaggaggcggcggtcgggggagggaggaaaaagagtaggagagagagcggcgaggagagagggaaaagaagggcggggtg

SEQ ID NO: 40468 - DNA, 505 bp, Artificial Sequence
  chemically treated genomic DNA (Homo sapiens) CpG-island No: 40468
caccccgcccttcttttccctctctcctcgccgctctctctcctactctttttcctccctcccccgaccgccgcctcctctcttcccgcgtccctcgtccgtctccgcccgacatctcctccatccacccctccactcccataacgctcccttcccgtctctcgcgtcccgcatccgctccgaccttctattcactctcgctaacctattacctactcgtctaccgacaattttcgtaaataatcgtacgaaactaacccgcccgcaacaataaaaataaaaaaattacgtatttcgtttattaaataacgaaaaaaaaaaaatataaaaatataaaacgacgaccgttcgtccttcgatcgaaaatcgttatatatcgccccctcccccccacttctcgtacgaccactaaaaacgcgaacgacgcgtatcttctctccttttcttaatacaaaaactcttccccaaactaataaatttaataaactcgaaaaataaaaaaacc

SEQ ID NO: 40469 - DNA, 701 bp, Artificial Sequence
  chemically treated genomic DNA (Homo sapiens) CpG-island No: 40469
ggttcgtgcgttaggaatttttgttttgttttcgcgtggtattttcgattttcggtcgtaggtagttgtattttttagtcgcgcgtttcgttttcgggcgttcggcgttttagtttcgattcgcgttcggtttcgtttcgtttagtgtgtttattttcggttcgtttcgtcgtttcgtcgttcggttttcgcggagtttcggagcgttattgcgcgggcgggttgatcgattagtcggtagttggtatcgggtgcgttggcgcgttagtggtttcgttttttagtcggtagtttcgcgcgttcggagttagcggtttaggcggcggcgtcgcgtaggggattcggagtaggcgggagggaagtagttaggcggggaggcggttgaggcggtagcggcggtagttagtcggtgtttcgatagttcggggcgtattttagtttcgtcgtttttagtttgggatttggggatcgggcgtttgtttagttcgcgttttagcgcggttatatggttttatttcgcgcgttgttgttttatttgttgtttttgtattgtgcgttttgcgtcgtcgcgggtagtcggattttaggtgcgtgcgggttgggcgcgcgggggttcgtggggttcggggtgtacgcggttagggtggtttaaggttgttttagttattcgggtagggtttttcgcgggtgggaggtagtat

SEQ ID NO: 40470 - DNA, 701 bp, Artificial Sequence
  chemically treated genomic DNA (Homo sapiens) CpG-island No: 40470
atactacctcccacccgcgaaaaaccctacccgaataactaaaacaaccttaaaccaccctaaccgcgtacaccccgaaccccacgaacccccgcgcgcccaacccgcacgcacctaaaatccgactacccgcgacgacgcaaaacgcacaatacaaaaacaacaaataaaacaacaacgcgcgaaataaaaccatataaccgcgctaaaacgcgaactaaacaaacgcccgatccccaaatcccaaactaaaaacgacgaaactaaaatacgccccgaactatcgaaacaccgactaactaccgccgctaccgcctcaaccgcctccccgcctaactacttccctcccgcctactccgaatcccctacgcgacgccgccgcctaaaccgctaactccgaacgcgcgaaactaccgactaaaaaacgaaaccactaacgcgccaacgcacccgataccaactaccgactaatcgatcaacccgcccgcgcaataacgctccgaaactccgcgaaaaccgaacgacgaaacgacgaaacgaaccgaaaataaacacactaaacgaaacgaaaccgaacgcgaatcgaaactaaaacgccgaacgcccgaaaacgaaacgcgcgactaaaaaatacaactacctacgaccgaaaatcgaaaataccacgcgaaaacaaaacaaaaattcctaacgcacgaacc

SEQ ID NO: 40471 - DNA, 701 bp, Artificial Sequence
  chemically treated genomic DNA (Homo sapiens) CpG-island No: 40471
atattgttttttattcgcggggaattttgttcgggtggttggggtaattttgggttattttgatcgcgtgtatttcggattttacgggttttcgcgcgtttaattcgtacgtatttggggttcggttgttcgcggcggcgtagagcgtatagtgtaaaggtagtaggtaggatagtagcgcgcggagtggagttatgtggtcgcgttgggacgcgggttgggtaagcgttcgatttttaagttttaggttgagggcggcgaggttagggtgcgtttcgggttgtcggagtatcggttggttgtcgtcgttgtcgttttagtcgttttttcgtttagttgtttttttttcgtttgtttcgggttttttgcgcggcgtcgtcgtttggatcgttggtttcgggcgcgcgaggttgtcggttggagagcggggttattgacgcgttagcgtattcggtgttaattgtcggttggtcggttagttcgttcgcgtagtgacgtttcgggatttcgcgggagtcgggcgacggggcggcgggacgggtcgggggtgggtatattgggcggggcggggtcgggcgcgggtcggagttggggcgtcgggcgttcgggggcggggcgcgcggttggggagtgtagttgtttgcggtcggggatcggaagtgttacgcggagatagagtaggggtttttggcgtacggatt

SEQ ID NO: 40472 - DNA, 701 bp, Artificial Sequence
  chemically treated genomic DNA (Homo sapiens) CpG-island No: 40472
aatccgtacgccaaaaacccctactctatctccgcgtaacacttccgatccccgaccgcaaacaactacactccccaaccgcgcgccccgcccccgaacgcccgacgccccaactccgacccgcgcccgaccccgccccgcccaatatacccacccccgacccgtcccgccgccccgtcgcccgactcccgcgaaatcccgaaacgtcactacgcgaacgaactaaccgaccaaccgacaattaacaccgaatacgctaacgcgtcaataaccccgctctccaaccgacaacctcgcgcgcccgaaaccaacgatccaaacgacgacgccgcgcaaaaaacccgaaacaaacgaaaaaaaaacaactaaacgaaaaaacgactaaaacgacaacgacgacaaccaaccgatactccgacaacccgaaacgcaccctaacctcgccgccctcaacctaaaacttaaaaatcgaacgcttacccaacccgcgtcccaacgcgaccacataactccactccgcgcgctactatcctacctactacctttacactatacgctctacgccgccgcgaacaaccgaaccccaaatacgtacgaattaaacgcgcgaaaacccgtaaaatccgaaatacacgcgatcaaaataacccaaaattaccccaaccacccgaacaaaattccccgcgaataaaaaacaatat

SEQ ID NO: 40473 - DNA, 510 bp, Artificial Sequence
  chemically treated genomic DNA (Homo sapiens) CpG-island No: 40473
tatagcgcgtttatttgatttatcgttatgtttagcgttacgcgtcgagagcgtatattattgtagtttcgggattacgaggtacgatagttttttcggcgagattattcgttggtatcgggtcgcggcgggcggcgggggtgggaagttggaggaggagcgttagtagtaattcgcgttgggaagaagtcggcgttgcgtacgcgttcggttcgttattgcgtacgcgttcgcggaagtggcggttttcgtgtgtaggttgagtttaggtgggcggggcgggaggcggaagggtcgcggtgcgtagtcgcgttaacggtttttcgtagcgggcgcgttgttagattttagtttggcggttgtattgttgggcgcgtcgttttcgtttgatttttgttggggacggttgttcgggtaggattttttacgattttttttcggttttttcgtcgttatagggaataaatttcgttcgaaatttattggatcgtttttagaaaggcgaaaaga

SEQ ID NO: 40474 - DNA, 510 bp, Artificial Sequence
  chemically treated genomic DNA (Homo sapiens) CpG-island No: 40474
tcttttcgcctttctaaaaacgatccaataaatttcgaacgaaatttattccctataacgacgaaaaaaccgaaaaaaaatcgtaaaaaatcctacccgaacaaccgtccccaacaaaaatcaaacgaaaacgacgcgcccaacaatacaaccgccaaactaaaatctaacaacgcgcccgctacgaaaaaccgttaacgcgactacgcaccgcgacccttccgcctcccgccccgcccacctaaactcaacctacacacgaaaaccgccacttccgcgaacgcgtacgcaataacgaaccgaacgcgtacgcaacgccgacttcttcccaacgcgaattactactaacgctcctcctccaacttcccacccccgccgcccgccgcgacccgataccaacgaataatctcgccgaaaaaactatcgtacctcgtaatcccgaaactacaataatatacgctctcgacgcgtaacgctaaacataacgataaatcaaataaacgcgctata

SEQ ID NO: 40475 - DNA, 510 bp, Artificial Sequence
  chemically treated genomic DNA (Homo sapiens) CpG-island No: 40475
ttttttcgtttttttaggagcggtttagtgagtttcgagcgagatttattttttgtgacgacggagaaatcgagaagggatcgtaaaggattttgttcgggtaatcgtttttagtagggattagacgagagcggcgcgtttagtaatgtagtcgttagattgaggtttgatagcgcgttcgttgcgaagggtcgttgacgcggttgcgtatcgcggttttttcgtttttcgtttcgtttatttaggtttaatttgtatacgggagtcgttattttcgcgggcgcgtgcgtagtggcgggtcgggcgcgtgcgtagcgtcggtttttttttagcgcgagttgttgttaacgttttttttttagttttttattttcgtcgttcgtcgcggttcggtattaacgggtggtttcgtcgagggagttgtcgtgtttcgtggtttcgggattgtagtggtgtgcgttttcggcgcgtggcgttaggtatggcgatggattaagtaaacgcgttgtg

SEQ ID NO: 40476 - DNA, 510 bp, Artificial Sequence
  chemically treated genomic DNA (Homo sapiens) CpG-island No: 40476
cacaacgcgtttacttaatccatcgccatacctaacgccacgcgccgaaaacgcacaccactacaatcccgaaaccacgaaacacgacaactccctcgacgaaaccacccgttaataccgaaccgcgacgaacgacgaaaataaaaaactaaaaaaaaaacgttaacaacaactcgcgctaaaaaaaaaccgacgctacgcacgcgcccgacccgccactacgcacgcgcccgcgaaaataacgactcccgtatacaaattaaacctaaataaacgaaacgaaaaacgaaaaaaccgcgatacgcaaccgcgtcaacgacccttcgcaacgaacgcgctatcaaacctcaatctaacgactacattactaaacgcgccgctctcgtctaatccctactaaaaacgattacccgaacaaaatcctttacgatcccttctcgatttctccgtcgtcacaaaaaataaatctcgctcgaaactcactaaaccgctcctaaaaaaacgaaaaaa

SEQ ID NO: 40477 - DNA, 503 bp, Artificial Sequence
  chemically treated genomic DNA (Homo sapiens) CpG-island No: 40477
tgcgggggtgcgtcgcgcgcggatgggttttcgaagtttggtgtttatgagtattgtttttttatttagttgtgtagtggaggggcgaaggtggtcggggtgtgtttagacgtgaggtggatcgacgtaagtcggtaggaggcgtatgttagtaatgtcggtggaatcgaggaggataaataagtgacgagtggggggtggggttgttggtgtagtgggggtgggtgtcggggaggggaaggagcggggggcggagggggagggggggtggggtgtgggggtgggggaggggaagggggtaagagggcgggcgaggcgcgttagcgagcgtggggtgagtagagaggcgtgttcgtaggttggaaatgtgaaacggtgtttaatgtcgttagtagcgttggaggtacgagaatgtgtatgttgggcggacggttgggagtgagggagggacgtcgtatacgattgtaggttattttgtttattgaggagaggttggtgagtaa

SEQ ID NO: 40478 - DNA, 503 bp, Artificial Sequence
  chemically treated genomic DNA (Homo sapiens) CpG-island No: 40478
ttactcaccaacctctcctcaataaacaaaataacctacaatcgtatacgacgtccctccctcactcccaaccgtccgcccaacatacacattctcgtacctccaacgctactaacgacattaaacaccgtttcacatttccaacctacgaacacgcctctctactcaccccacgctcgctaacgcgcctcgcccgccctcttacccccttcccctcccccacccccacaccccaccccccctccccctccgccccccgctccttcccctccccgacacccacccccactacaccaacaaccccaccccccactcgtcacttatttatcctcctcgattccaccgacattactaacatacgcctcctaccgacttacgtcgatccacctcacgtctaaacacaccccgaccaccttcgcccctccactacacaactaaataaaaaaacaatactcataaacaccaaacttcgaaaacccatccgcgcgcgacgcacccccgca

SEQ ID NO: 40479 - DNA, 503 bp, Artificial Sequence
  chemically treated genomic DNA (Homo sapiens) CpG-island No: 40479
ttatttattaatttttttttagtgagtaaaataatttatagtcgtatacggcgttttttttttatttttagtcgttcgtttaatatatatattttcgtgtttttaacgttattaacgatattgaatatcgttttatatttttagtttacgaatacgtttttttatttattttacgttcgttagcgcgtttcgttcgtttttttatttttttttttttttttatttttatattttatttttttttttttttcgtttttcgttttttttttttttcgatatttatttttattatattaataattttattttttattcgttatttgtttatttttttcgattttatcggtattattgatatacgttttttgtcgatttacgtcgatttattttacgtttaggtatatttcgattattttcgtttttttattatatagttaaatggagaggtaatatttatagatattaaatttcgggggtttattcgcgcgcgacgtattttcgta

SEQ ID NO: 40480 - DNA, 503 bp, Artificial Sequence
  chemically treated genomic DNA (Homo sapiens) CpG-island No: 40480
tacgaaaatacgtcgcgcgcgaataaacccccgaaatttaatatctataaatattacctctccatttaactatataataaaaaaacgaaaataatcgaaatatacctaaacgtaaaataaatcgacgtaaatcgacaaaaaacgtatatcaataataccgataaaatcgaaaaaaataaacaaataacgaataaaaaataaaattattaatataataaaaataaatatcgaaaaaaaaaaaaaacgaaaaacgaaaaaaaaaaaaaaataaaatataaaaataaaaaaaaaaaaaaaaataaaaaaacgaacgaaacgcgctaacgaacgtaaaataaataaaaaaacgtattcgtaaactaaaaatataaaacgatattcaatatcgttaataacgttaaaaacacgaaaatatatatattaaacgaacgactaaaaataaaaaaaaaacgccgtatacgactataaattattttactcactaaaaaaaaattaataaataa

SEQ ID NO: 40481 - DNA, 731 bp, Artificial Sequence
  chemically treated genomic DNA (Homo sapiens) CpG-island No: 40481
  misc_feature (404)..(404): n is either a, c, g or t
agagtggagaggatcggcgaggcgcgttagtcggagttatttttttttcggtcgttttttttttattttttttatatatatacgttcgttcgttcgtcggcgcgcgtatatttttcgcgtcggattcgtatttcggcgggcgttatatattcggtagttcgagtcgcggtagtcgtagcgggatggaggcggcgcgtacggagcgtttcgtaggtaggtcgggggcgtcgtttgttcggacggggtttttatttttgtcgacgtgggttttggtcggcgtcgagattatttgggacgcgataggcggtttcggacgttcggcggtttcggtttcgcggttatcggcgttgtttttattttcgtcgcgggtagtggttagttagtggtcggaggagttggcgttngcgcggagagtcgtcgtgttggggcgtcgggtcggattagagttgttgttttatttgggcggcggtagaagtcgtgagatgtatgtggaagtcggagggatattatcggtagcgagcggttgggttcgggtattttattttttgtaagtttggcggcgcgaggaggagtcgtcgggcgtagtttttaattatttaggaacgcggggacgtttgggttattgtttcggtcgatggttttagaggaagtcgtttttttgttaagggttttcgggaggaggtgaaggcgtcgcgggttggggggttttttttgaggattttcggttgttt

SEQ ID NO: 40482 - DNA, 731 bp, Artificial Sequence
  chemically treated genomic DNA (Homo sapiens) CpG-island No: 40482
  misc_feature (328)..(328): n is either a, c, g or t
aaacaaccgaaaatcctcaaaaaaaaccccccaacccgcgacgccttcacctcctcccgaaaacccttaacaaaaaaacgacttcctctaaaaccatcgaccgaaacaataacccaaacgtccccgcgttcctaaataattaaaaactacgcccgacgactcctcctcgcgccgccaaacttacaaaaaataaaatacccgaacccaaccgctcgctaccgataatatccctccgacttccacatacatctcacgacttctaccgccgcccaaataaaacaacaactctaatccgacccgacgccccaacacgacgactctccgcgcnaacgccaactcctccgaccactaactaaccactacccgcgacgaaaataaaaacaacgccgataaccgcgaaaccgaaaccgccgaacgtccgaaaccgcctatcgcgtcccaaataatctcgacgccgaccaaaacccacgtcgacaaaaataaaaaccccgtccgaacaaacgacgcccccgacctacctacgaaacgctccgtacgcgccgcctccatcccgctacgactaccgcgactcgaactaccgaatatataacgcccgccgaaatacgaatccgacgcgaaaaatatacgcgcgccgacgaacgaacgaacgtatatatataaaaaaaataaaaaaaaaacgaccgaaaaaaaaataactccgactaacgcgcctcgccgatcctctccactct

SEQ ID NO: 40483 - DNA, 731 bp, Artificial Sequence
  chemically treated genomic DNA (Homo sapiens) CpG-island No: 40483
  misc_feature (328)..(328): n is either a, c, g or t
gggtagtcggaggtttttaaaaaaaattttttagttcgcggcgtttttattttttttcgggaatttttagtaaggggacggttttttttggaattatcggtcggagtagtggtttaggcgttttcgcgtttttgggtgattgggggttgcgttcggcgattttttttcgcgtcgttaagtttgtaggaggtgggatgttcgggtttagtcgttcgttgtcggtaatgttttttcggtttttatatgtattttacggtttttgtcgtcgtttagatggggtagtagttttggttcggttcggcgttttagtacgacggtttttcgcgtngacgttagttttttcggttattggttggttattgttcgcggcgagagtggagataacgtcggtggtcgcgaagtcggggtcgtcgggcgttcgggatcgtttgtcgcgttttaagtgatttcggcgtcggttaggatttacgtcgataagagtaggagtttcgttcggataagcggcgttttcggtttgtttgcggggcgtttcgtgcgcgtcgtttttatttcgttgcggttatcgcggttcgggttgtcgagtgtgtggcgttcgtcgaggtgcgggttcggcgcggggggtgtgcgcgcgtcggcgagcgagcgagcgtgtgtgtgtagggggagtggggagggggcggtcgggaaggaggtggtttcggttggcgcgtttcgtcggttttttttatttt

SEQ ID NO: 40484 - DNA, 731 bp, Artificial Sequence
  chemically treated genomic DNA (Homo sapiens) CpG-island No: 40484
  misc_feature (404)..(404): n is either a, c, g or t
aaaataaaaaaaaccgacgaaacgcgccaaccgaaaccacctccttcccgaccgccccctccccactccccctacacacacacgctcgctcgctcgccgacgcgcgcacaccccccgcgccgaacccgcacctcgacgaacgccacacactcgacaacccgaaccgcgataaccgcaacgaaataaaaacgacgcgcacgaaacgccccgcaaacaaaccgaaaacgccgcttatccgaacgaaactcctactcttatcgacgtaaatcctaaccgacgccgaaatcacttaaaacgcgacaaacgatcccgaacgcccgacgaccccgacttcgcgaccaccgacgttatctccactctcgccgcgaacaataaccaaccaataaccgaaaaaactaacgtcnacgcgaaaaaccgtcgtactaaaacgccgaaccgaaccaaaactactaccccatctaaacgacgacaaaaaccgtaaaatacatataaaaaccgaaaaaacattaccgacaacgaacgactaaacccgaacatcccacctcctacaaacttaacgacgcgaaaaaaaatcgccgaacgcaacccccaatcacccaaaaacgcgaaaacgcctaaaccactactccgaccgataattccaaaaaaaaccgtccccttactaaaaattcccgaaaaaaaataaaaacgccgcgaactaaaaaattttttttaaaaacctccgactaccc

SEQ ID NO: 40485 - DNA, 566 bp, Artificial Sequence
  chemically treated genomic DNA (Homo sapiens) CpG-island No: 40485
tagttgtaaagacggatgtgtacggaacgcgggaaaacgttatgggcggagggggtaattgattggggagggcgattaagaacgggaaggaggagaggtttaagggtgaggtgtaagacgatcgtacgggagcgacgggagggtgcgcggggacgaacggggacgcggggtggtaggggaacgatcggggttgggggggtggaaaagtacgaagattcgggacgtgggggtggggtaagcggaggtcgcggtaaacggtaagttaggcgtgtacggcgtgggcgagaggtttagacgtgtggtaggggggtattttcgggacggtaatttgaggtatcggagattcggtcggggcggttggggataggtagaggtttgaacggatgtattgaaaagatgggcgtaagggcggaaggtttcgtcgggggttttggttttggggtcgtgtatgtttttaaacgttcgggcgcgatgggagtgtgtatgcgcggggagttggtgcgtttttttaaaagggtttgcggtttgaggagagggacggttaggtgtaggtttgtagattttat

SEQ ID NO: 40486 - DNA, 566 bp, Artificial Sequence
  chemically treated genomic DNA (Homo sapiens) CpG-island No: 40486
ataaaatctacaaacctacacctaaccgtccctctcctcaaaccgcaaacccttttaaaaaaacgcaccaactccccgcgcatacacactcccatcgcgcccgaacgtttaaaaacatacacgaccccaaaaccaaaacccccgacgaaaccttccgcccttacgcccatcttttcaatacatccgttcaaacctctacctatccccaaccgccccgaccgaatctccgatacctcaaattaccgtcccgaaaatacccccctaccacacgtctaaacctctcgcccacgccgtacacgcctaacttaccgtttaccgcgacctccgcttaccccacccccacgtcccgaatcttcgtacttttccacccccccaaccccgatcgttcccctaccaccccgcgtccccgttcgtccccgcgcaccctcccgtcgctcccgtacgatcgtcttacacctcacccttaaacctctcctccttcccgttcttaatcgccctccccaatcaattaccccctccgcccataacgttttcccgcgttccgtacacatccgtctttacaacta

SEQ ID NO: 40487 - DNA, 566 bp, Artificial Sequence
  chemically treated genomic DNA (Homo sapiens) CpG-island No: 40487
gtgggatttatagatttatatttgatcgtttttttttttaggtcgtaggtttttttgggggggcgtattagtttttcgcgtatatatatttttatcgcgttcgggcgtttaaagatatatacgattttaaggttaggattttcggcggaatttttcgtttttgcgtttatttttttagtatattcgtttagatttttatttgtttttaatcgtttcgatcggattttcgatgttttaggttatcgtttcgggggtatttttttattatacgtttgaatttttcgtttacgtcgtgtacgtttgatttatcgtttgtcgcggttttcgtttattttatttttacgtttcgagttttcgtatttttttatttttttagtttcgatcgtttttttgttatttcgcgttttcgttcgttttcgcgtattttttcgtcgttttcgtgcgatcgttttatattttatttttaaattttttttttttttcgtttttaatcgttttttttagttaattatttttttcgtttataacgttttttcgcgtttcgtatatattcgtttttgtaatta

SEQ ID NO: 40488 - DNA, 566 bp, Artificial Sequence
  chemically treated genomic DNA (Homo sapiens) CpG-island No: 40488
taattacaaaaacgaatatatacgaaacgcgaaaaaacgttataaacgaaaaaaataattaactaaaaaaaacgattaaaaacgaaaaaaaaaaaaaatttaaaaataaaatataaaacgatcgcacgaaaacgacgaaaaaatacgcgaaaacgaacgaaaacgcgaaataacaaaaaaacgatcgaaactaaaaaaataaaaaaatacgaaaactcgaaacgtaaaaataaaataaacgaaaaccgcgacaaacgataaatcaaacgtacacgacgtaaacgaaaaattcaaacgtataataaaaaaatacccccgaaacgataacctaaaacatcgaaaatccgatcgaaacgattaaaaacaaataaaaatctaaacgaatatactaaaaaaataaacgcaaaaacgaaaaattccgccgaaaatcctaaccttaaaatcgtatatatctttaaacgcccgaacgcgataaaaatatatatacgcgaaaaactaatacgcccccccaaaaaaacctacgacctaaaaaaaaaaacgatcaaatataaatctataaatcccac

SEQ ID NO: 40489 - DNA, 764 bp, Artificial Sequence
  chemically treated genomic DNA (Homo sapiens) CpG-island No: 40489
tgtaggacgcgttttttttttacgtcgtagggttgcggggcggcgattaggttttttcgaggggttgaagtttttttgggggtggttgagagcggtcgtatttttggtagtattttttttttcgaaaacgcgttttaaaagtagcggttgcgggcgtgggtatagttaattttagtttgcgtttattataagtcgggagggcgcggaattgcggttttttcgagacgcgttcgggtcgtcgtcgtagtattgtcgtagcgattttttcgttcgggttttcgcgagtaaacgggtaagtttcgttattacgtaggttatatattttacgagtaaaaggaaaaaatcgggtagataataaagtttaattcgcgggggtttaagcgagttggaagttgggggcgttggggttgtagtttaaggaggagcggcggggacgacgggatgcggggttgatgcgtttgggacgcggtaagttatatgttagttcgggtgttgatagcggggaggatattgggtacgcggcggcgtcggggaggcggtcggggtaagataggtttgaggcgggaggggagcggcggcgaggtttcgaggcgtcgcggtcggtcgtgatttttattttagtcggggcgttgtttcgttttttatcggtagggaagttgcgggtttcgtcggggttatttcggtcgttggttttcggagttaggaagcgtttttatatcgcgggcgagagggtcgggtgggttagggacgttcgattttttacg

SEQ ID NO: 40490 - DNA, 764 bp, Artificial Sequence
  chemically treated genomic DNA (Homo sapiens) CpG-island No: 40490
cgtaaaaaatcgaacgtccctaacccacccgaccctctcgcccgcgatataaaaacgcttcctaactccgaaaaccaacgaccgaaataaccccgacgaaacccgcaacttccctaccgataaaaaacgaaacaacgccccgactaaaataaaaatcacgaccgaccgcgacgcctcgaaacctcgccgccgctcccctcccgcctcaaacctatcttaccccgaccgcctccccgacgccgccgcgtacccaatatcctccccgctatcaacacccgaactaacatataacttaccgcgtcccaaacgcatcaaccccgcatcccgtcgtccccgccgctcctccttaaactacaaccccaacgcccccaacttccaactcgcttaaacccccgcgaattaaactttattatctacccgattttttccttttactcgtaaaatatataacctacgtaataacgaaacttacccgtttactcgcgaaaacccgaacgaaaaaatcgctacgacaatactacgacgacgacccgaacgcgtctcgaaaaaaccgcaattccgcgccctcccgacttataataaacgcaaactaaaattaactatacccacgcccgcaaccgctacttttaaaacgcgttttcgaaaaaaaaaatactaccaaaaatacgaccgctctcaaccacccccaaaaaaacttcaacccctcgaaaaaacctaatcgccgccccgcaaccctacgacgtaaaaaaaaaacgcgtcctaca

SEQ ID NO: 40491 - DNA, 764 bp, Artificial Sequence
  chemically treated genomic DNA (Homo sapiens) CpG-island No: 40491
cgtgaggagtcgggcgtttttggtttattcggttttttcgttcgcgatgtgggggcgttttttggtttcggaggttagcggtcgggatagtttcggcggagttcgtagtttttttgtcggtaaggaacgggatagcgtttcggttggggtgggggttacggtcgatcgcggcgtttcgggatttcgtcgtcgtttttttttcgttttaggtttgttttatttcggtcgttttttcgacgtcgtcgcgtgtttagtgtttttttcgttgttagtattcgggttgatatatggtttgtcgcgttttaggcgtattagtttcgtatttcgtcgttttcgtcgtttttttttgggttgtagttttagcgtttttaatttttagttcgtttgggttttcgcgggttgggttttattgtttgttcggttttttttttttattcgtggggtgtgtgatttgcgtgataacggggtttgttcgtttgttcgcggggattcgggcgggaaggtcgttgcgatagtgttgcggcggcggttcgggcgcgtttcggaggggtcgtagtttcgcgttttttcgatttatggtaggcgtaggttggggttggttgtgtttacgttcgtagtcgttatttttagggcgcgttttcgggagggaggatgttgttagagatgcggtcgtttttagttatttttaagggaattttagtttttcggaggaatttggtcgtcgtttcgtagttttgcggcgtaagaggagggcgcgttttgta

SEQ ID NO: 40492 - DNA, 764 bp, Artificial Sequence
  chemically treated genomic DNA (Homo sapiens) CpG-island No: 40492
tacaaaacgcgccctcctcttacgccgcaaaactacgaaacgacgaccaaattcctccgaaaaactaaaattcccttaaaaataactaaaaacgaccgcatctctaacaacatcctccctcccgaaaacgcgccctaaaaataacgactacgaacgtaaacacaaccaaccccaacctacgcctaccataaatcgaaaaaacgcgaaactacgacccctccgaaacgcgcccgaaccgccgccgcaacactatcgcaacgaccttcccgcccgaatccccgcgaacaaacgaacaaaccccgttatcacgcaaatcacacaccccacgaataaaaaaaaaaaaccgaacaaacaataaaacccaacccgcgaaaacccaaacgaactaaaaattaaaaacgctaaaactacaacccaaaaaaaaacgacgaaaacgacgaaatacgaaactaatacgcctaaaacgcgacaaaccatatatcaacccgaatactaacaacgaaaaaaacactaaacacgcgacgacgtcgaaaaaacgaccgaaataaaacaaacctaaaacgaaaaaaaaacgacgacgaaatcccgaaacgccgcgatcgaccgtaacccccaccccaaccgaaacgctatcccgttccttaccgacaaaaaaactacgaactccgccgaaactatcccgaccgctaacctccgaaaccaaaaaacgcccccacatcgcgaacgaaaaaaccgaataaaccaaaaacgcccgactcctcacg

SEQ ID NO: 40493 - DNA, 668 bp, Artificial Sequence
  chemically treated genomic DNA (Homo sapiens) CpG-island No: 40493
ggaaatgcgttttcgcggcgcgagtgggaggggtattttgatcgcgtttttggaggtttcgttagtttttcgatattcgggttttttgcgttttttcgtcgtaagtttgtatttttagcgagtttttttattattttagggtcgttttagtcgtttaaatttatcgtttcgggcgtagttttttgtttacgggattttcgcgttttttaagttttgtgtttttaattttcgggtatttatcgtttagtagcggtagtagtaggacgttgagtagaggtaatcggcggggtttggtcggggattttcgcgtagtttttatcgcggcgggtttaggaaaaggagttgagggcgtacggcgggcgcgtagattgcgtttcgcggcgggtataggaggcggagcgtatcggagcgcgggcgtcgtagtagtagtcgtagtcggagttcgatttcgaggcgtttcgaggcgtttcgagtcggagtcgcgcgcgtttagtattttcgagttttcgcgcgtcgtcgtcgtcgtcgttaagtttcgttttacgacgttttttttttttcggttttcgtacggcgtttcgttttttcgacgtttttttttcgtcgaggcggggaggagtttagtagggggaggggtttggagagggatggagaatagagagagtaag

SEQ ID NO: 40494 - DNA, 668 bp, Artificial Sequence
  chemically treated genomic DNA (Homo sapiens) CpG-island No: 40494
cttactctctctattctccatccctctccaaacccctccccctactaaactcctccccgcctcgacgaaaaaaaaacgtcgaaaaaacgaaacgccgtacgaaaaccgaaaaaaaaaaaacgtcgtaaaacgaaacttaacgacgacgacgacgacgcgcgaaaactcgaaaatactaaacgcgcgcgactccgactcgaaacgcctcgaaacgcctcgaaatcgaactccgactacgactactactacgacgcccgcgctccgatacgctccgcctcctatacccgccgcgaaacgcaatctacgcgcccgccgtacgccctcaactccttttcctaaacccgccgcgataaaaactacgcgaaaatccccgaccaaaccccgccgattacctctactcaacgtcctactactaccgctactaaacgataaatacccgaaaattaaaaacacaaaacttaaaaaacgcgaaaatcccgtaaacaaaaaactacgcccgaaacgataaatttaaacgactaaaacgaccctaaaataataaaaaaactcgctaaaaatacaaacttacgacgaaaaaacgcaaaaaacccgaatatcgaaaaactaacgaaacctccaaaaacgcgatcaaaatacccctcccactcgcgccgcgaaaacgcatttcc

SEQ ID NO: 40495 - DNA, 668 bp, Artificial Sequence
  chemically treated genomic DNA (Homo sapiens) CpG-island No: 40495
tttgttttttttattttttatttttttttagatttttttttttattgagttttttttcgtttcggcgaggagggggcgtcgagggggcggggcgtcgtgcgggggtcggaggggagggggcgtcgtggggcggggtttggcggcggcggcggcggcgcgcggggattcggaggtattgggcgcgcgcggtttcggttcgggacgtttcgggacgtttcggggtcgggtttcggttgcggttgttgttgcggcgttcgcgtttcggtgcgtttcgttttttgtgttcgtcgcggagcgtagtttgcgcgttcgtcgtgcgtttttagtttttttttttgagttcgtcgcgatgggagttgcgcggggattttcggttagatttcgtcggttgtttttgtttagcgttttgttgttgtcgttgttgggcggtgagtattcgagagttgggggtatagagtttgggaagcgcgggagtttcgtgggtaaaaggttgcgttcggggcggtgggtttgggcggttggaacggttttggagtagtggagaggttcgttgggggtgtaggtttgcggcggaagggcgtaaggagttcgggtgtcgggaggttggcgaagtttttagggacgcggttagggtattttttttattcgcgtcgcggggacgtattttt

SEQ ID NO: 40496 - DNA, 668 bp, Artificial Sequence
  chemically treated genomic DNA (Homo sapiens) CpG-island No: 40496
aaaaatacgtccccgcgacgcgaataaaaaaaataccctaaccgcgtccctaaaaacttcgccaacctcccgacacccgaactccttacgcccttccgccgcaaacctacacccccaacgaacctctccactactccaaaaccgttccaaccgcccaaacccaccgccccgaacgcaaccttttacccacgaaactcccgcgcttcccaaactctatacccccaactctcgaatactcaccgcccaacaacgacaacaacaaaacgctaaacaaaaacaaccgacgaaatctaaccgaaaatccccgcgcaactcccatcgcgacgaactcaaaaaaaaaaactaaaaacgcacgacgaacgcgcaaactacgctccgcgacgaacacaaaaaacgaaacgcaccgaaacgcgaacgccgcaacaacaaccgcaaccgaaacccgaccccgaaacgtcccgaaacgtcccgaaccgaaaccgcgcgcgcccaatacctccgaatccccgcgcgccgccgccgccgccgccaaaccccgccccacgacgccccctcccctccgacccccgcacgacgccccgccccctcgacgccccctcctcgccgaaacgaaaaaaaactcaataaaaaaaaaaatctaaaaaaaaataaaaaataaaaaaaacaaa

SEQ ID NO: 40497 - DNA, 568 bp, Artificial Sequence
  chemically treated genomic DNA (Homo sapiens) CpG-island No: 40497
aacgcgtgcgggtcgaattttttttttcgttttgttttaataatataggacgtcggggttcgcgtcgcgtattatttggatttttcgtcgattatgtttcggatcgaattttttacgcgtgttcggatcgatcggagtatatagttggcgattaaggtgggttcggaaattttttttttttcgtcgcggttttcgggtgtttttcgaatttcggtattcgcggtgtattttttgttttttcgtttgttttttgggcgttaaaatcgggcggagcggtggatcggcgagcggcgggacggggtgggtggggattgcgagcgagtgggtaggggtggggggagcggtagacgcgacggtgttgggatttcgggagggagcggagcggatttgggtttggtcgtttttaagtcggcgggatcgagtgttttaggtcgtttgaaagaaagttgtttcggtaagggacggagcgggaagagggaggtgtgtgtttcgcgggtgggggcggtggaagtttcggtatttttttttatttcgggttttatcggtttgggtttggcgtggcgatttt

SEQ ID NO: 40498 - DNA, 568 bp, Artificial Sequence
  chemically treated genomic DNA (Homo sapiens) CpG-island No: 40498
aaaatcgccacgccaaacccaaaccgataaaacccgaaataaaaaaaaataccgaaacttccaccgcccccacccgcgaaacacacacctccctcttcccgctccgtcccttaccgaaacaactttctttcaaacgacctaaaacactcgatcccgccgacttaaaaacgaccaaacccaaatccgctccgctccctcccgaaatcccaacaccgtcgcgtctaccgctccccccacccctacccactcgctcgcaatccccacccaccccgtcccgccgctcgccgatccaccgctccgcccgattttaacgcccaaaaaacaaacgaaaaaacaaaaaatacaccgcgaataccgaaattcgaaaaacacccgaaaaccgcgacgaaaaaaaaaaaatttccgaacccaccttaatcgccaactatatactccgatcgatccgaacacgcgtaaaaaattcgatccgaaacataatcgacgaaaaatccaaataatacgcgacgcgaaccccgacgtcctatattattaaaacaaaacgaaaaaaaaaattcgacccgcacgcgtt

SEQ ID NO: 40499 - DNA, 568 bp, Artificial Sequence
  chemically treated genomic DNA (Homo sapiens) CpG-island No: 40499
ggggtcgttacgttaagtttaagtcggtggggttcggggtgagaggaggtgtcggagtttttatcgtttttattcgcgagatatatattttttttttttcgtttcgttttttatcggagtaatttttttttaagcggtttaaagtattcggtttcgtcggtttggaggcgattaagtttaggttcgtttcgttttttttcgggattttagtatcgtcgcgtttgtcgttttttttatttttatttattcgttcgtagtttttatttatttcgtttcgtcgttcgtcgatttatcgtttcgttcgattttggcgtttagaaagtaggcggggagataggagatgtatcgcgggtgtcggggttcggggagtattcgaggatcgcggcgaaaggagaggggttttcgagtttattttgatcgttagttatgtgtttcggtcgattcgagtacgcgtgagggattcgattcgagatataatcggcgggggatttaggtagtacgcggcgcggatttcggcgttttgtattgttggggtaaggcggggggaggggttcggttcgtacgcgtt

SEQ ID NO: 40500 - DNA, 568 bp, Artificial Sequence
  chemically treated genomic DNA (Homo sapiens) CpG-island No: 40500
aacgcgtacgaaccgaacccctccccccgccttaccccaacaatacaaaacgccgaaatccgcgccgcgtactacctaaatcccccgccgattatatctcgaatcgaatccctcacgcgtactcgaatcgaccgaaacacataactaacgatcaaaataaactcgaaaacccctctcctttcgccgcgatcctcgaatactccccgaaccccgacacccgcgatacatctcctatctccccgcctactttctaaacgccaaaatcgaacgaaacgataaatcgacgaacgacgaaacgaaataaataaaaactacgaacgaataaataaaaataaaaaaaacgacaaacgcgacgatactaaaatcccgaaaaaaaacgaaacgaacctaaacttaatcgcctccaaaccgacgaaaccgaatactttaaaccgcttaaaaaaaaattactccgataaaaaacgaaacgaaaaaaaaaaaatatatatctcgcgaataaaaacgataaaaactccgacacctcctctcaccccgaaccccaccgacttaaacttaacgtaacgacccc

SEQ ID NO: 40501 - DNA, 551 bp, Artificial Sequence
  chemically treated genomic DNA (Homo sapiens) CpG-island No: 40501
gtttacgcgttttcgggtgttggtggttcgtaggcggcgcgcgtcgggcgtgttgtttttcgatttcgtttttttttttttttcgttcgttatatttttttttttttttttttttcgtttttcgttttttatttcgcggtagtttttttttttttcgatgtatcgtttgatttttcgtttttttttttcgagttttttcgtttattcgttgttcgtttttttttttaatagttcgtcgtttttagttgtgttataatatcgatttttcgttcgtcgaatcgcgcgtgtcgtttcgtttcgttttttcgttttacgttttatagtaatttatcgtcgtattttttttttgtttttttgacgtttttttttaggacgtttaattttaacgtggcggcgttgtttcgtttgattcgtttaatttttattttatttttttttacgtcggtcggtatcggcgcgtatttttttttttttaatttatacgtacgttatatatttatgcgtttattttatttttttatttttagttacgacgaaaatacgagaattgt

SEQ ID NO: 40502 - DNA, 551 bp, Artificial Sequence
  chemically treated genomic DNA (Homo sapiens) CpG-island No: 40502
acaattctcgtattttcgtcgtaactaaaaataaaaaaataaaataaacgcataaatatataacgtacgtataaattaaaaaaaaaaaaatacgcgccgataccgaccgacgtaaaaaaaaataaaataaaaattaaacgaatcaaacgaaacaacgccgccacgttaaaattaaacgtcctaaaaaaaaacgtcaaaaaaacaaaaaaaaaatacgacgataaattactataaaacgtaaaacgaaaaaacgaaacgaaacgacacgcgcgattcgacgaacgaaaaatcgatattataacacaactaaaaacgacgaactattaaaaaaaaaaacgaacaacgaataaacgaaaaaactcgaaaaaaaaaaacgaaaaatcaaacgatacatcgaaaaaaaaaaaaactaccgcgaaataaaaaacgaaaaacgaaaaaaaaaaaaaaaaaaaaatataacgaacgaaaaaaaaaaaaaaacgaaatcgaaaaacaacacgcccgacgcgcgccgcctacgaaccaccaacacccgaaaacgcgtaaac

SEQ ID NO: 40503 - DNA, 551 bp, Artificial Sequence
  chemically treated genomic DNA (Homo sapiens) CpG-island No: 40503
ataattttcgtgttttcgtcgtggttgggagtgggagagtagaatgggcgtatgggtgtgtggcgtgcgtgtgggttggggggaaaagggtgcgcgtcgatgtcggtcggcgtgagggggagtggggtgggagttaagcgagttaagcggagtaacgtcgttacgttggggttgagcgttttgggaggagacgttagaggaataagaagggagtgcggcgatgggttgttatggggcgtggagcgaggggacggggcggggcggtacgcgcggttcgacgagcggggggtcggtattgtgatataattgggggcggcgggttattggggagaggggcgggtaacgagtaaacggggggattcgagagaggggggcggggagttagacgatgtatcggggagaggagggattgtcgcggggtaggaagcgaggggcggggagggagggagggggggagtgtgacgggcgggggaagggggggagcgaggtcggagggtagtacgttcgacgcgcgtcgtttgcgggttattagtattcgggggcgcgtgagt

SEQ ID NO: 40504 - DNA, 551 bp, Artificial Sequence
  chemically treated genomic DNA (Homo sapiens) CpG-island No: 40504
actcacgcgcccccgaatactaataacccgcaaacgacgcgcgtcgaacgtactaccctccgacctcgctcccccccttcccccgcccgtcacactccccccctccctccctccccgcccctcgcttcctaccccgcgacaatccctcctctccccgatacatcgtctaactccccgcccccctctctcgaatccccccgtttactcgttacccgcccctctccccaataacccgccgcccccaattatatcacaataccgaccccccgctcgtcgaaccgcgcgtaccgccccgccccgtcccctcgctccacgccccataacaacccatcgccgcactcccttcttattcctctaacgtctcctcccaaaacgctcaaccccaacgtaacgacgttactccgcttaactcgcttaactcccaccccactccccctcacgccgaccgacatcgacgcgcacccttttccccccaacccacacgcacgccacacacccatacgcccattctactctcccactcccaaccacgacgaaaacacgaaaattat

SEQ ID NO: 40505 - DNA, 665 bp, Artificial Sequence
  chemically treated genomic DNA (Homo sapiens) CpG-island No: 40505
gcgcggaatagtaggaaagtatagaattaggcgggtcggcgcgagggcggagaggttgaggcgcgtttttataggtgtttgcggggcgggcgggttttttagaagtttagtaagtcgttgagtttcgcggagacgcgcggcggcgtcgttaagcgttacgcgtgcgagttatgcgggaaggtttatttttatcgcggtatattttagtagtataggcgtttgtatacgggcgagcggttttattagtgttttttttgcgataaggtttatatttggtttttcgattatcggaagtatattcgtatttatataggcgagaaattttattcgtgtttagattgcgggaaggttttcgtgcgtttttcggatttgcgtaaatattagcgtaatatgtatagtaataataagtttttttcgtgtttcgagtgcggtttgatttttaataagtcgttgtcgttgttgcgttattagcgtacgtatttgggcgttaagttttttcgttgtttcgtttgcgatcgggagttcgttgtggttagtcgtatggtggagtattagcgcgtgtattcgggcgagcggttttttttttgttttatttgcggtaagtgttttattaagttttttaatttgttcgagtattagacgttgtatatcggttagaggttttt

SEQ ID NO: 40506 - DNA, 665 bp, Artificial Sequence
  chemically treated genomic DNA (Homo sapiens) CpG-island No: 40506
aaaaacctctaaccgatatacaacgtctaatactcgaacaaattaaaaaacttaataaaacacttaccgcaaataaaacaaaaaaaaaaccgctcgcccgaatacacgcgctaatactccaccatacgactaaccacaacgaactcccgatcgcaaacgaaacaacgaaaaaacttaacgcccaaatacgtacgctaataacgcaacaacgacaacgacttattaaaaatcaaaccgcactcgaaacacgaaaaaaacttattattactatacatattacgctaatatttacgcaaatccgaaaaacgcacgaaaaccttcccgcaatctaaacacgaataaaatttctcgcctatataaatacgaatatacttccgataatcgaaaaaccaaatataaaccttatcgcaaaaaaaacactaataaaaccgctcgcccgtatacaaacgcctatactactaaaatataccgcgataaaaataaaccttcccgcataactcgcacgcgtaacgcttaacgacgccgccgcgcgtctccgcgaaactcaacgacttactaaacttctaaaaaacccgcccgccccgcaaacacctataaaaacgcgcctcaacctctccgccctcgcgccgacccgcctaattctatactttcctactattccgcgc

SEQ ID NO: 40507 - DNA, 665 bp, Artificial Sequence
  chemically treated genomic DNA (Homo sapiens) CpG-island No: 40507
aaaggtttttggtcggtgtgtagcgtttggtgttcggatagattggaggatttggtgaagtatttgtcgtaggtggggtaggggaagggtcgttcgttcgagtgtacgcgttggtgttttattatgcggttggttatagcgaattttcggtcgtaggcggggtagcggaagggtttggcgtttaggtgcgtgcgttggtggcgtagtagcgatagcggtttgttgaaggttaggtcgtattcggagtacgggaagggtttattgttgttgtgtatgttgcgttggtgtttgcgtaggttcgaagagcgtacgaaggttttttcgtagtttggatacgggtagggtttttcgtttgtgtgggtgcggatgtgttttcggtggtcggaggattaggtgtaggttttgtcgtagaaggagtattggtagggtcgttcgttcgtgtgtaggcgtttgtgttgttggagtgtgtcgcggtgggagtaggttttttcgtatagttcgtacgcgtagcgtttggcggcgtcgtcgcgcgttttcgcggggtttagcggtttgttgggtttttgaaaggttcgttcgtttcgtaggtatttgtagggacgcgttttagttttttcgttttcgcgtcggttcgtttggttttgtatttttttgttgtttcgcgt

SEQ ID NO: 40508 - DNA, 665 bp, Artificial Sequence
  chemically treated genomic DNA (Homo sapiens) CpG-island No: 40508
acgcgaaacaacaaaaaaatacaaaaccaaacgaaccgacgcgaaaacgaaaaaactaaaacgcgtccctacaaatacctacgaaacgaacgaacctttcaaaaacccaacaaaccgctaaaccccgcgaaaacgcgcgacgacgccgccaaacgctacgcgtacgaactatacgaaaaaacctactcccaccgcgacacactccaacaacacaaacgcctacacacgaacgaacgaccctaccaatactccttctacgacaaaacctacacctaatcctccgaccaccgaaaacacatccgcacccacacaaacgaaaaaccctacccgtatccaaactacgaaaaaaccttcgtacgctcttcgaacctacgcaaacaccaacgcaacatacacaacaacaataaacccttcccgtactccgaatacgacctaaccttcaacaaaccgctatcgctactacgccaccaacgcacgcacctaaacgccaaacccttccgctaccccgcctacgaccgaaaattcgctataaccaaccgcataataaaacaccaacgcgtacactcgaacgaacgacccttcccctaccccacctacgacaaatacttcaccaaatcctccaatctatccgaacaccaaacgctacacaccgaccaaaaaccttt

SEQ ID NO: 40509 - DNA, 626 bp, Artificial Sequence
  chemically treated genomic DNA (Homo sapiens) CpG-island No: 40509
gtgtcggtcggtttcgttatggagttaggtgtaggttatttcgacggttatcgcgcggggagtttaagttttcgttaggttttgtgcgacggaagcgtagtgatgttttttagtaaagaacgcggacgttgtatcgtgattaattttgtttttttggaggcgtcgttacggtttacgtttcgttcgcgttaagtgattgaggtttgtggtggagaaggacgtgtcgtgtcgttgggttttgagtcggagtggtcggtgggtgggatggaggcgattttggagtagtatttggaagatacgtgagtagtgcgcgttttttcggtttgttttgaggtcgcggcggaggaatttgagcggaacgaaaggcgcgagttgcgagtatcggttagggcgtttcggggacgtcgcgcgattttcgggatacgggatgagggggttaaattttatttaaggtcgtagggcggggcgggtgattcggaattaaaattttgtcgggtatcgtatatttttttttgagcgagtttttcgggtttaggttacgggttaaaattgtttatttcgttgttgaaatcgtttttacggttagggtggttttgcggaagttttagaaaacgggttgatttttg

SEQ ID NO: 40510 - DNA, 626 bp, Artificial Sequence
  chemically treated genomic DNA (Homo sapiens) CpG-island No: 40510
caaaaatcaacccgttttctaaaacttccgcaaaaccaccctaaccgtaaaaacgatttcaacaacgaaataaacaattttaacccgtaacctaaacccgaaaaactcgctcaaaaaaaaatatacgatacccgacaaaattttaattccgaatcacccgccccgccctacgaccttaaataaaatttaaccccctcatcccgtatcccgaaaatcgcgcgacgtccccgaaacgccctaaccgatactcgcaactcgcgcctttcgttccgctcaaattcctccgccgcgacctcaaaacaaaccgaaaaaacgcgcactactcacgtatcttccaaatactactccaaaatcgcctccatcccacccaccgaccactccgactcaaaacccaacgacacgacacgtccttctccaccacaaacctcaatcacttaacgcgaacgaaacgtaaaccgtaacgacgcctccaaaaaaacaaaattaatcacgatacaacgtccgcgttctttactaaaaaacatcactacgcttccgtcgcacaaaacctaacgaaaacttaaactccccgcgcgataaccgtcgaaataacctacacctaactccataacgaaaccgaccgacac

SEQ ID NO: 40511 - DNA, 626 bp, Artificial Sequence
  chemically treated genomic DNA (Homo sapiens) CpG-island No: 40511
taaaagttaattcgttttttaaaattttcgtagaattattttgatcgtaaagacgattttaataacgagataggtagttttggttcgtggtttgggttcgggagattcgtttaagagggaatgtgcggtgttcggtaggattttaatttcgggttattcgtttcgttttgcggttttgggtagagtttagtttttttatttcgtgtttcgggggtcgcgcgacgttttcgagacgttttggtcggtattcgtagttcgcgtttttcgtttcgtttaagttttttcgtcgcgattttaggataggtcgaagaggcgcgtattatttacgtgttttttaagtgttgttttaaggtcgtttttattttatttatcgattatttcggtttagaatttagcggtacggtacgtttttttttattataggttttagttatttgacgcgagcggggcgtggatcgtaacggcgtttttaaagggataaaattgattacggtgtaacgttcgcgttttttattggaaaatattattgcgttttcgtcgtatagagtttgacgaaggtttgggtttttcgcgcggtgatcgtcgaggtgatttgtatttggttttatggcggaatcggtcggtat

SEQ ID NO: 40512 - DNA, 626 bp, Artificial Sequence
  chemically treated genomic DNA (Homo sapiens) CpG-island No: 40512
ataccgaccgattccgccataaaaccaaatacaaatcacctcgacgatcaccgcgcgaaaaacccaaaccttcgtcaaactctatacgacgaaaacgcaataatattttccaataaaaaacgcgaacgttacaccgtaatcaattttatccctttaaaaacgccgttacgatccacgccccgctcgcgtcaaataactaaaacctataataaaaaaaaacgtaccgtaccgctaaattctaaaccgaaataatcgataaataaaataaaaacgaccttaaaacaacacttaaaaaacacgtaaataatacgcgcctcttcgacctatcctaaaatcgcgacgaaaaaacttaaacgaaacgaaaaacgcgaactacgaataccgaccaaaacgtctcgaaaacgtcgcgcgacccccgaaacacgaaataaaaaaactaaactctacccaaaaccgcaaaacgaaacgaataacccgaaattaaaatcctaccgaacaccgcacattccctcttaaacgaatctcccgaacccaaaccacgaaccaaaactacctatctcgttattaaaatcgtctttacgatcaaaataattctacgaaaattttaaaaaacgaattaactttta

SEQ ID NO: 40513 - DNA, 620 bp, Artificial Sequence
  chemically treated genomic DNA (Homo sapiens) CpG-island No: 40513
ggattcgcgcggggattcgggtaggttgtaaacgttggggagatgttataggagcgtttgtttttttagttttttttttttttcgtcgagggtttttggggtttagcgttttcggcgtttcggcgattttcgggttcgttttgtttttttttagttggggagttgagttcggttttgcgtttatcgtcgatttcggttatttttttttcgttgttcgttttaaaagcgtttgtttcgtttcgcggggcgatttttttttttcggttttggggttgaagattttgtgtggggtagttgcgttttcgggatagttttagtcgcggagcgtttagattagggtagtcggagtcgggttatacgtcgtacgtcgtcggggtcgtcgtatttgagtttagttttagttacgtcggaagcgcgggcggagcgtacgggttcggggagagtcgtttgcgttcgcgagggggatttaagtatttagggtggtggtcgagtttcgtttttcgttagcgggggcgaggatttgcgacgcgtatttttgtttggttcggtttttttagtattagttttacgtatattttatttttttagtttttcgtttttattttgttaatttttttgag

SEQ ID NO: 40514 - DNA, 620 bp, Artificial Sequence
  chemically treated genomic DNA (Homo sapiens) CpG-island No: 40514
ctcaaaaaaattaacaaaataaaaacgaaaaactaaaaaaataaaatatacgtaaaactaatactaaaaaaaccgaaccaaacaaaaatacgcgtcgcaaatcctcgcccccgctaacgaaaaacgaaactcgaccaccaccctaaatacttaaatccccctcgcgaacgcaaacgactctccccgaacccgtacgctccgcccgcgcttccgacgtaactaaaactaaactcaaatacgacgaccccgacgacgtacgacgtataacccgactccgactaccctaatctaaacgctccgcgactaaaactatcccgaaaacgcaactaccccacacaaaatcttcaaccccaaaaccgaaaaaaaaaaatcgccccgcgaaacgaaacaaacgcttttaaaacgaacaacgaaaaaaaaataaccgaaatcgacgataaacgcaaaaccgaactcaactccccaactaaaaaaaaacaaaacgaacccgaaaatcgccgaaacgccgaaaacgctaaaccccaaaaaccctcgacgaaaaaaaaaaaaaactaaaaaaacaaacgctcctataacatctccccaacgtttacaacctacccgaatccccgcgcgaatcc

SEQ ID NO: 40515 - DNA, 620 bp, Artificial Sequence
  chemically treated genomic DNA (Homo sapiens) CpG-island No: 40515
tttagggaagttggtagggtgagggcgaagaattgaggaagtagggtgtgcgtggggttggtgttgaggagatcgggttaggtaggggtgcgcgtcgtaggttttcgttttcgttggcgggaggcgggattcggttattattttaggtatttgggtttttttcgcgggcgtaggcgatttttttcggattcgtgcgtttcgttcgcgttttcggcgtgattggagttgggtttaggtgcggcggtttcggcggcgtgcggcgtatgattcgatttcggttgttttggtttgggcgtttcgcggttggggttgtttcgaaggcgtagttgttttatataggatttttaattttagggtcgaaagggagaagtcgtttcgcggggcgggataggcgtttttggagcgagtagcgaagggagagtggtcggggtcggcgatgggcgtagagtcgggtttagttttttagttgggaggggatagggcggattcggaggtcgtcgaaacgtcgggagcgttgaattttagagattttcggcgagagaaaggagaagttgggaaggtaggcgtttttgtggtatttttttagcgtttgtagtttattcgagttttcgcgcgggttt

SEQ ID NO: 40516 - DNA, 620 bp, Artificial Sequence
  chemically treated genomic DNA (Homo sapiens) CpG-island No: 40516
aaacccgcgcgaaaactcgaataaactacaaacgctaaaaaaataccacaaaaacgcctaccttcccaacttctcctttctctcgccgaaaatctctaaaattcaacgctcccgacgtttcgacgacctccgaatccgccctatcccctcccaactaaaaaactaaacccgactctacgcccatcgccgaccccgaccactctcccttcgctactcgctccaaaaacgcctatcccgccccgcgaaacgacttctccctttcgaccctaaaattaaaaatcctatataaaacaactacgccttcgaaacaaccccaaccgcgaaacgcccaaaccaaaacaaccgaaatcgaatcatacgccgcacgccgccgaaaccgccgcacctaaacccaactccaatcacgccgaaaacgcgaacgaaacgcacgaatccgaaaaaaatcgcctacgcccgcgaaaaaaacccaaatacctaaaataataaccgaatcccgcctcccgccaacgaaaacgaaaacctacgacgcgcacccctacctaacccgatctcctcaacaccaaccccacgcacaccctacttcctcaattcttcgccctcaccctaccaacttccctaaa

SEQ ID NO: 40517 - DNA, 564 bp, Artificial Sequence
  chemically treated genomic DNA (Homo sapiens) CpG-island No: 40517
tgttcggcgagatcgcgatgttcggggagatcgtaatgtttcgggggatcgtaatgtacggggagacggcgatgttcgggggtatcgcgatgttcggggggatcgcgatgttcggggagatcgcgttattcggggggacggcgatgttcgggggggattacgatgttcggagggatcgcgatgttggggtagaacgcgatgttcgggggtatcgcgtcggtgttattagaagttttttggtttgcggggtaagtagtagtcgtaggaattagattcggcggaaaggagtcgcggaggggaattgagtgtttttagtcgggtatgttcggcgagatcgcgatgttcggtgagatggtaatgttcggggagatcgcgattttcggggagatcgcgatgttcggggagatcgcgttgttcggagagagggcgatgttcggagaggtcgcgatgttcggggagattacgatgttcggggagatagtatcggtttttttagaaattttttggtttgaggggtaagtagtagtcgtaggaagcggattcggcggaaaggagttatcgagg

SEQ ID NO: 40518 - DNA, 564 bp, Artificial Sequence
  chemically treated genomic DNA (Homo sapiens) CpG-island No: 40518
cctcgataactcctttccgccgaatccgcttcctacgactactacttacccctcaaaccaaaaaatttctaaaaaaaccgatactatctccccgaacatcgtaatctccccgaacatcgcgacctctccgaacatcgccctctctccgaacaacgcgatctccccgaacatcgcgatctccccgaaaatcgcgatctccccgaacattaccatctcaccgaacatcgcgatctcgccgaacatacccgactaaaaacactcaattcccctccgcgactcctttccgccgaatctaattcctacgactactacttaccccgcaaaccaaaaaacttctaataacaccgacgcgatacccccgaacatcgcgttctaccccaacatcgcgatccctccgaacatcgtaatcccccccgaacatcgccgtccccccgaataacgcgatctccccgaacatcgcgatccccccgaacatcgcgatacccccgaacatcgccgtctccccgtacattacgatcccccgaaacattacgatctccccgaacatcgcgatctcgccgaaca

SEQ ID NO: 40519 - DNA, 564 bp, Artificial Sequence
  chemically treated genomic DNA (Homo sapiens) CpG-island No: 40519
tttcggtggttttttttcgtcgggttcgttttttgcggttgttgtttgttttttaggttaggaggtttttggaaggatcggtgttgttttttcgaatatcgtggttttttcgaatatcgcggttttttcgaatatcgtttttttttcgagtaacgcgattttttcgaatatcgcggttttttcgaaaatcgcgattttttcgaatattgttattttatcgaatatcgcgatttcgtcgaatatgttcggttgaaggtatttagttttttttcgcggttttttttcgtcgggtttgatttttgcggttgttgtttgtttcgtaggttaggaggtttttggtagtatcggcgcgatgttttcgaatatcgcgttttattttaatatcgcgattttttcgaatatcgtgatttttttcgaatatcgtcgttttttcgagtaacgcggttttttcgaatatcgcggttttttcgaatatcgcggtattttcgaatatcgtcgttttttcgtatattgcgatttttcgaaatattgcgattttttcgaatatcgcgatttcgtcgaata

SEQ ID NO: 40520 - DNA, 564 bp, Artificial Sequence
  chemically treated genomic DNA (Homo sapiens) CpG-island No: 40520
tattcgacgaaatcgcgatattcgaaaaaatcgcaatatttcgaaaaatcgcaatatacgaaaaaacgacgatattcgaaaataccgcgatattcgaaaaaaccgcgatattcgaaaaaaccgcgttactcgaaaaaacgacgatattcgaaaaaaatcacgatattcgaaaaaatcgcgatattaaaataaaacgcgatattcgaaaacatcgcgccgatactaccaaaaacctcctaacctacgaaacaaacaacaaccgcaaaaatcaaacccgacgaaaaaaaaccgcgaaaaaaaactaaataccttcaaccgaacatattcgacgaaatcgcgatattcgataaaataacaatattcgaaaaaatcgcgattttcgaaaaaaccgcgatattcgaaaaaatcgcgttactcgaaaaaaaaacgatattcgaaaaaaccgcgatattcgaaaaaaccacgatattcgaaaaaacaacaccgatccttccaaaaacctcctaacctaaaaaacaaacaacaaccgcaaaaaacgaacccgacgaaaaaaaaccaccgaaa

SEQ ID NO: 40521 - DNA, 864 bp, Artificial Sequence
  chemically treated genomic DNA (Homo sapiens) CpG-island No: 40521
attagtcgttttcgaagttttttacgatcgtattttattgttatttttttttgttggtgtcgtcgttgttgttgttgttgaatttgttttgtagcggtcgtcgtggttacgggcgtcgagttttttcgggaggagtttgagtcgttgttggagtcggggttgttatcggcgttatttcgggggttttggaagaaaattcgtgcgtcgtcgtcgttggtttcgtcggtcgtttcgttgttgttcgtcgttatcgatatgttttcgcgcgttcgagttttagtgcggttcggaggaggggcgggcggagcgcgttcggcgtcgttattattttcggttcggtagtcgtatgcgaagggtttttcggtatttgttttgcgtcgcgcgcgtttagtcgttcggttgttttgggagggcgggaggagtcgcggcgagagggaggagggcggggaggacgacggggcggggatcgtagttttaaagaagtcgtcgaggattttttcggtttagtttttagaggcgggatttggcgtttgcggtagagagggttcggggcgtgggagttttcgcggggcgggaaatgtgtgcgtttagatacgggaggtcgtcgatgtgtagatttcggaaggacgggcgtggggcggggtgttaggggatgtttttgcgcgggtgttcgtggtttttagtttcggagatagggatttacgtttttttcgtaatttcggagcgtaggaaacgcgtcgtttttcggggtttttatttggcgcggtttcgggtaggattcgtagcgaaggggatataggaaaggatcgcgtcgtaggtttttttaggaggtttttttagttttatcgttttttttgttggttg

SEQ ID NO: 40522 - DNA, 864 bp, Artificial Sequence
  chemically treated genomic DNA (Homo sapiens) CpG-island No: 40522
caaccaacaaaaaaaacgataaaactaaaaaaacctcctaaaaaaacctacgacgcgatcctttcctatatccccttcgctacgaatcctacccgaaaccgcgccaaataaaaaccccgaaaaacgacgcgtttcctacgctccgaaattacgaaaaaaacgtaaatccctatctccgaaactaaaaaccacgaacacccgcgcaaaaacatcccctaacaccccgccccacgcccgtccttccgaaatctacacatcgacgacctcccgtatctaaacgcacacatttcccgccccgcgaaaactcccacgccccgaaccctctctaccgcaaacgccaaatcccgcctctaaaaactaaaccgaaaaaatcctcgacgacttctttaaaactacgatccccgccccgtcgtcctccccgccctcctccctctcgccgcgactcctcccgccctcccaaaacaaccgaacgactaaacgcgcgcgacgcaaaacaaataccgaaaaacccttcgcatacgactaccgaaccgaaaataataacgacgccgaacgcgctccgcccgcccctcctccgaaccgcactaaaactcgaacgcgcgaaaacatatcgataacgacgaacaacaacgaaacgaccgacgaaaccaacgacgacgacgcacgaattttcttccaaaacccccgaaataacgccgataacaaccccgactccaacaacgactcaaactcctcccgaaaaaactcgacgcccgtaaccacgacgaccgctacaaaacaaattcaacaacaacaacaacgacgacaccaacaaaaaaaaataacaataaaatacgatcgtaaaaaacttcgaaaacgactaat

SEQ ID NO: 40523 - DNA, 864 bp, Artificial Sequence
  chemically treated genomic DNA (Homo sapiens) CpG-island No: 40523
tagttaatagaggagacggtggggttaggaaaattttttgggggagtttgcggcgcggtttttttttgtgtttttttcgttgcgggttttgttcggggtcgcgttaggtggaggtttcgagaggcggcgcgttttttgcgtttcgggattgcgggagaagcgtgagtttttgttttcgagattagaggttacggatattcgcgtaggagtattttttggtatttcgttttacgttcgttttttcggagtttatatatcggcgatttttcgtgtttaggcgtatatatttttcgtttcgcggagatttttacgtttcgggttttttttgtcgtaggcgttagatttcgtttttgggggttggatcgagagggttttcggcggtttttttaaggttgcggttttcgtttcgtcgtttttttcgtttttttttttttcgtcgcggtttttttcgtttttttagagtagtcgggcggttgggcgcgcgcggcgtagagtaggtgtcggggagtttttcgtatgcggttgtcgggtcggaggtggtagcggcgtcgggcgcgtttcgttcgtttttttttcgggtcgtattgaggttcgggcgcgcggggatatgtcggtggcgacgggtagtagcgagacggtcggcggggttagcggcggcggcgtacgggtttttttttaaagttttcggggtggcgtcggtggtagtttcggttttagtagcggtttaggtttttttcgggaggattcggcgttcgtggttacggcggtcgttgtagggtaggtttagtagtaatagtagcggcgatattagtagggaaaagtgatagtgaaatacgatcgtaaggagtttcggaagcggttggt

SEQ ID NO: 40524 - DNA, 864 bp, Artificial Sequence
  chemically treated genomic DNA (Homo sapiens) CpG-island No: 40524
accaaccgcttccgaaactccttacgatcgtatttcactatcacttttccctactaatatcgccgctactattactactaaacctaccctacaacgaccgccgtaaccacgaacgccgaatcctcccgaaaaaaacctaaaccgctactaaaaccgaaactaccaccgacgccaccccgaaaactttaaaaaaaaacccgtacgccgccgccgctaaccccgccgaccgtctcgctactacccgtcgccaccgacatatccccgcgcgcccgaacctcaatacgacccgaaaaaaaaacgaacgaaacgcgcccgacgccgctaccacctccgacccgacaaccgcatacgaaaaactccccgacacctactctacgccgcgcgcgcccaaccgcccgactactctaaaaaaacgaaaaaaaccgcgacgaaaaaaaaaaaaacgaaaaaaacgacgaaacgaaaaccgcaaccttaaaaaaaccgccgaaaaccctctcgatccaacccccaaaaacgaaatctaacgcctacgacaaaaaaaacccgaaacgtaaaaatctccgcgaaacgaaaaatatatacgcctaaacacgaaaaatcgccgatatataaactccgaaaaaacgaacgtaaaacgaaataccaaaaaatactcctacgcgaatatccgtaacctctaatctcgaaaacaaaaactcacgcttctcccgcaatcccgaaacgcaaaaaacgcgccgcctctcgaaacctccacctaacgcgaccccgaacaaaacccgcaacgaaaaaaacacaaaaaaaaaccgcgccgcaaactcccccaaaaaattttcctaaccccaccgtctcctctattaacta

SEQ ID NO: 40525 - DNA, 619 bp, Artificial Sequence
  chemically treated genomic DNA (Homo sapiens) CpG-island No: 40525
atatcgatcgtcgattcgtaggttagaagtaaaaggagttttttttcgattagaaatattcgatttcggtattttttattcggtcgcggtcgtttcgtcgtttttagtcgtagcgttcgttcgcgtttgtttcgttcggggttttaattttattgtattcggtttttcgcgttttttttcgtgtcgttttttcgtttttcgcgttttattcgttcgtcgttttttttaattttttttttttcgttcggattcgcgtcgtttttatattttcgtttcgcgcgtcgatatcgttttatttcgttttcgtttcgtagttttcgcgcgtatttcgtttcgtttttcgtatagtcgtcgttttcgttattttttttttttatttttttcgtatttcgcgggcgttttcgtagtttattttttttacgtcgttttcgcggttcgtgatacgttcgtttgcgtttcggttattttcgttcgtcgattatacgtaggaagagaagcgttattcgttcgttcgtcgtagaatttttttattttttttcgtttaatatttattattatttcgcgagagttcgtacgatttatcgttttttattgattatatttttttttttttttttat

SEQ ID NO: 40526 - DNA, 619 bp, Artificial Sequence
  chemically treated genomic DNA (Homo sapiens) CpG-island No: 40526
ataaaaaaaaaaaaaaaaatataatcaataaaaaacgataaatcgtacgaactctcgcgaaataataataaatattaaacgaaaaaaaataaaaaaattctacgacgaacgaacgaataacgcttctcttcctacgtataatcgacgaacgaaaataaccgaaacgcaaacgaacgtatcacgaaccgcgaaaacgacgtaaaaaaaataaactacgaaaacgcccgcgaaatacgaaaaaaataaaaaaaaaaaataacgaaaacgacgactatacgaaaaacgaaacgaaatacgcgcgaaaactacgaaacgaaaacgaaataaaacgatatcgacgcgcgaaacgaaaatataaaaacgacgcgaatccgaacgaaaaaaaaaaaattaaaaaaaacgacgaacgaataaaacgcgaaaaacgaaaaaacgacacgaaaaaaaacgcgaaaaaccgaatacaataaaattaaaaccccgaacgaaacaaacgcgaacgaacgctacgactaaaaacgacgaaacgaccgcgaccgaataaaaaataccgaaatcgaatatttctaatcgaaaaaaaactccttttacttctaacctacgaatcgacgatcgatat

SEQ ID NO: 40527 - DNA, 619 bp, Artificial Sequence
  chemically treated genomic DNA (Homo sapiens) CpG-island No: 40527
atgaggggggggagggggatgtggttaatgagggacggtgggtcgtgcgggttttcgcggggtggtggtgggtgttgggcggggggaggtgggggggttttgcggcgggcgggcgggtggcgtttttttttttgcgtgtggtcggcgggcgggggtgatcggggcgtaggcgggcgtattacgggtcgcgggggcggcgtggagggggtgggttgcggggacgttcgcggggtacggggggggtaggggggaaaggtggcgggggcggcggttgtgcggggggcggggcgggatacgcgcggggattgcggggcggaggcggggtggggcggtgtcggcgcgcggggcgggagtgtgggggcgacgcgggttcgggcgggggggggggggttggggggggcggcgggcggatggggcgcggggggcggggggacggtacgagggggggcgcggggggtcgagtgtagtggggttggggtttcgggcggggtaggcgcgggcgggcgttgcggttggggacggcggggcggtcgcggtcgggtggggggtatcggggtcggatgtttttggtcgggggggggttttttttgtttttgatttacgggtcggcggtcgatgt

SEQ ID NO: 40528 - DNA, 619 bp, Artificial Sequence
  chemically treated genomic DNA (Homo sapiens) CpG-island No: 40528
acatcgaccgccgacccgtaaatcaaaaacaaaaaaaacccccccccgaccaaaaacatccgaccccgataccccccacccgaccgcgaccgccccgccgtccccaaccgcaacgcccgcccgcgcctaccccgcccgaaaccccaaccccactacactcgaccccccgcgccccccctcgtaccgtccccccgccccccgcgccccatccgcccgccgccccccccaacccccccccccccgcccgaacccgcgtcgcccccacactcccgccccgcgcgccgacaccgccccaccccgcctccgccccgcaatccccgcgcgtatcccgccccgccccccgcacaaccgccgcccccgccacctttcccccctaccccccccgtaccccgcgaacgtccccgcaacccaccccctccacgccgcccccgcgacccgtaatacgcccgcctacgccccgatcacccccgcccgccgaccacacgcaaaaaaaaaaacgccacccgcccgcccgccgcaaaacccccccacctccccccgcccaacacccaccaccaccccgcgaaaacccgcacgacccaccgtccctcattaaccacatccccctcccccccctcat

SEQ ID NO: 40529 - DNA, 984 bp, Artificial Sequence
  chemically treated genomic DNA (Homo sapiens) CpG-island No: 40529
gggtgcgttgaattttgtttgtttttagaggtagtcgatcggttttcgtttttatcgattttttttggcggttagcgttttatacgcggtttgttcgtttgggagttagtatcgttttttttcgtcggtttttaaagggtcggggcgtttttatttcgttgacgatggtggagtgggtttgggcgtagcgttagtcgtcgcggtacggtataaggggagtcgagcggttggggaaggcggcgagtgggttcgcgtagttgagagcgttagtggcggaggcgttgtcgttggtcgtttttaggaggtagcgttggtagcggtcgcggcgttcggggggttttgggtcgcgggaggcgggcgtcgtgcggttttatttttttttcgggttttagtcgtagcgttcggttagcgtcgcggtatttggttcgcggtattagtagtggtcgggttgcgtgtttaggaagattacgtcgacgaagaggaaggcgaaggtgacgttcgttaggtatagtagtaaaaatacgcgtttttggaagcgttcgaattcgtttattcgttgtagcgtttcgtcgaaggagggtatggtgcgttcgtcgttcgtcgttcgtagttcgcgtttcggagtgattcgcggatttagtcggcggtttttttttatttcgtcgtttttttcgcgttattcgttttattcgttttggcgttgtgtcggtcgtagtcgttttttttgtttttcgcggttttcgtttttttttttcgggcgttcgtagtagtttcgggttataggtcgcgggagggacggtcgcgagtcggacgtattcggtcggggtgggcgcgcggtggggttcgggcggtgcggtttgattacgcgttagggattcggtcgggatcgcgagtgacgggcgtagttttcggtttggcgcggagttttttttggtttttgttagtagtttgttttgtagttagttttaggtcgggttttagaag

SEQ ID NO: 40530 - DNA, 984 bp, Artificial Sequence
  chemically treated genomic DNA (Homo sapiens) CpG-island No: 40530
cttctaaaacccgacctaaaactaactacaaaacaaactactaacaaaaaccaaaaaaaactccgcgccaaaccgaaaactacgcccgtcactcgcgatcccgaccgaatccctaacgcgtaatcaaaccgcaccgcccgaaccccaccgcgcgcccaccccgaccgaatacgtccgactcgcgaccgtccctcccgcgacctataacccgaaactactacgaacgcccgaaaaaaaaaaacgaaaaccgcgaaaaacaaaaaaaacgactacgaccgacacaacgccaaaacgaataaaacgaataacgcgaaaaaaacgacgaaataaaaaaaaaccgccgactaaatccgcgaatcactccgaaacgcgaactacgaacgacgaacgacgaacgcaccataccctccttcgacgaaacgctacaacgaataaacgaattcgaacgcttccaaaaacgcgtatttttactactatacctaacgaacgtcaccttcgccttcctcttcgtcgacgtaatcttcctaaacacgcaacccgaccactactaataccgcgaaccaaataccgcgacgctaaccgaacgctacgactaaaacccgaaaaaaaaataaaaccgcacgacgcccgcctcccgcgacccaaaaccccccgaacgccgcgaccgctaccaacgctacctcctaaaaacgaccaacgacaacgcctccgccactaacgctctcaactacgcgaacccactcgccgccttccccaaccgctcgactccccttataccgtaccgcgacgactaacgctacgcccaaacccactccaccatcgtcaacgaaataaaaacgccccgaccctttaaaaaccgacgaaaaaaaacgatactaactcccaaacgaacaaaccgcgtataaaacgctaaccgccaaaaaaaatcgataaaaacgaaaaccgatcgactacctctaaaaacaaacaaaattcaacgcaccc

SEQ ID NO: 40531 - DNA, 984 bp, Artificial Sequence
  chemically treated genomic DNA (Homo sapiens) CpG-island No: 40531
tttttggagttcgatttggggttgattgtagagtaggttgttggtagggattaaaaggagtttcgcgttaggtcggaggttgcgttcgttattcgcggtttcggtcgggtttttggcgcgtagttaggtcgtatcgttcgagttttatcgcgcgtttatttcggtcgggtgcgttcggttcgcggtcgtttttttcgcgatttgtggttcggggttgttgcgggcgttcggggaagagaggcgggggtcgcggggggtaggaggagcggttgcggtcggtatagcgttagggcgagtgaggcgggtggcgcgggggaggcggcggagtaaagagaggtcgtcggttgggttcgcgggttatttcgaggcgcgggttgcgggcggcgggcggcgggcgtattatgttttttttcgacgaggcgttgtagcgggtgggcgagttcgggcgtttttagaggcgcgtgtttttgttgttgtgtttgacgggcgttattttcgttttttttttcgtcggcgtggtttttttgggtacgtagttcgattattattggtgtcgcgggttaagtgtcgcggcgttggtcgagcgttgcggttggagttcggaggaggagtggaatcgtacggcgttcgtttttcgcggtttagagtttttcgagcgtcgcggtcgttgttagcgttattttttggaggcggttaacgatagcgttttcgttattagcgtttttagttgcgcggatttattcgtcgttttttttaatcgttcggttttttttgtgtcgtgtcgcggcggttggcgttacgtttaggtttattttattatcgttagcgaggtaagggcgtttcggttttttggaagtcggcgggagaggacgatgttggtttttaggcggataagtcgcgtgtgagacgttggtcgttaggggaggtcggtggagacggggatcggtcggttatttttggggatagataggatttagcgtattt

SEQ ID NO: 40532 - DNA, 984 bp, Artificial Sequence
  chemically treated genomic DNA (Homo sapiens) CpG-island No: 40532
aaatacgctaaatcctatctatccccaaaaataaccgaccgatccccgtctccaccgacctcccctaacgaccaacgtctcacacgcgacttatccgcctaaaaaccaacatcgtcctctcccgccgacttccaaaaaaccgaaacgcccttacctcgctaacgataataaaataaacctaaacgtaacgccaaccgccgcgacacgacacaaaaaaaaccgaacgattaaaaaaaacgacgaataaatccgcgcaactaaaaacgctaataacgaaaacgctatcgttaaccgcctccaaaaaataacgctaacaacgaccgcgacgctcgaaaaactctaaaccgcgaaaaacgaacgccgtacgattccactcctcctccgaactccaaccgcaacgctcgaccaacgccgcgacacttaacccgcgacaccaataataatcgaactacgtacccaaaaaaaccacgccgacgaaaaaaaaaacgaaaataacgcccgtcaaacacaacaacaaaaacacgcgcctctaaaaacgcccgaactcgcccacccgctacaacgcctcgtcgaaaaaaaacataatacgcccgccgcccgccgcccgcaacccgcgcctcgaaataacccgcgaacccaaccgacgacctctctttactccgccgcctcccccgcgccacccgcctcactcgccctaacgctataccgaccgcaaccgctcctcctaccccccgcgacccccgcctctcttccccgaacgcccgcaacaaccccgaaccacaaatcgcgaaaaaaacgaccgcgaaccgaacgcacccgaccgaaataaacgcgcgataaaactcgaacgatacgacctaactacgcgccaaaaacccgaccgaaaccgcgaataacgaacgcaacctccgacctaacgcgaaactccttttaatccctaccaacaacctactctacaatcaaccccaaatcgaactccaaaaa

SEQ ID NO: 40533 - DNA, 536 bp, Artificial Sequence
  chemically treated genomic DNA (Homo sapiens) CpG-island No: 40533
gggatagtagtgttgcgaaatgcgaggaagtcgcgggggagggagattcgtaatagtatataacgcgcggcgggacggagggcgttgggtgcggttagcggaagagggagggtggcggttgggcggtgcgcgtatgggcgcgcgagcgttttcgagttttatatgttttagagtgggtcgtgcggggggggagggcgtggtatcggggttagcggcgtggtgtttttttgggcgggcgtaagagaggacgtgcgggagcgcgcggggtggagtacgggcggggatgagtggtgggggcgggggagggggggcgcggcgcggggggttgggaggggtggaattatcgattgtagcgggcgtttttttattttggtgtcgggggttatgggattttcgataggggtgttagaaatgggatggtatttgaggcgggggggggggcgcgtttttattcgacgcgcggggtgttgttttcggtaggattatattttttttttaatattatcgtgtttttttattaaatttttttttataat

SEQ ID NO: 40534 - DNA, 536 bp, Artificial Sequence
  chemically treated genomic DNA (Homo sapiens) CpG-island No: 40534
attataaaaaaaaatttaataaaaaaacacgataatattaaaaaaaaaatataatcctaccgaaaacaacaccccgcgcgtcgaataaaaacgcgcccccccccccgcctcaaataccatcccatttctaacacccctatcgaaaatcccataacccccgacaccaaaataaaaaaacgcccgctacaatcgataattccacccctcccaaccccccgcgccgcgccccccctcccccgcccccaccactcatccccgcccgtactccaccccgcgcgctcccgcacgtcctctcttacgcccgcccaaaaaaacaccacgccgctaaccccgataccacgccctccccccccgcacgacccactctaaaacatataaaactcgaaaacgctcgcgcgcccatacgcgcaccgcccaaccgccaccctccctcttccgctaaccgcacccaacgccctccgtcccgccgcgcgttatatactattacgaatctccctcccccgcgacttcctcgcatttcgcaacactactatccc

SEQ ID NO: 40535 - DNA, 536 bp, Artificial Sequence
  chemically treated genomic DNA (Homo sapiens) CpG-island No: 40535
gttataagaagaaatttaataaaaaaatacgataatgttggggggggggtgtaattttatcgagagtaatatttcgcgcgtcgggtagaggcgcgttttttttttcgttttaaatattattttatttttaatatttttatcgagggttttatagttttcgatattaaggtggaaaagcgttcgttgtaatcgatgattttattttttttaatttttcgcgtcgcgttttttttttttcgtttttattatttattttcgttcgtgttttatttcgcgcgttttcgtacgtttttttttacgttcgtttaggaaggtattacgtcgttaatttcggtattacgtttttttttttcgtacggtttattttaaaatatatgaagttcggaggcgttcgcgcgtttatacgcgtatcgtttagtcgttattttttttttttcgttaatcgtatttagcgtttttcgtttcgtcgcgcgttatgtattattgcgggtttttttttttcgcgattttttcgtatttcgtagtattattgtttt

SEQ ID NO: 40536 - DNA, 536 bp, Artificial Sequence
  chemically treated genomic DNA (Homo sapiens) CpG-island No: 40536
aaaacaataatactacgaaatacgaaaaaatcgcgaaaaaaaaaaacccgcaataatacataacgcgcgacgaaacgaaaaacgctaaatacgattaacgaaaaaaaaaaaataacgactaaacgatacgcgtataaacgcgcgaacgcctccgaacttcatatattttaaaataaaccgtacgaaaaaaaaaaacgtaataccgaaattaacgacgtaataccttcctaaacgaacgtaaaaaaaaacgtacgaaaacgcgcgaaataaaacacgaacgaaaataaataataaaaacgaaaaaaaaaaaacgcgacgcgaaaaattaaaaaaaataaaatcatcgattacaacgaacgcttttccaccttaatatcgaaaactataaaaccctcgataaaaatattaaaaataaaataatatttaaaacgaaaaaaaaaacgcgcctctacccgacgcgcgaaatattactctcgataaaattacaccccccccccaacattatcgtatttttttattaaatttcttcttataac

SEQ ID NO: 40537 - DNA, 517 bp, Artificial Sequence
  chemically treated genomic DNA (Homo sapiens) CpG-island No: 40537
  misc_feature (69)..(69): n is either a, c, g or t
  misc_feature (226)..(226): n is either a, c, g or t
  misc_feature (363)..(363): n is either a, c, g or t
  misc_feature (376)..(376): n is either a, c, g or t
  misc_feature (408)..(408): n is either a, c, g or t
  misc_feature (420)..(420): n is either a, c, g or t
  misc_feature (438)..(438): n is either a, c, g or t
  misc_feature (457)..(457): n is either a, c, g or t
  misc_feature (467)..(467): n is either a, c, g or t
tcgttgcgcggttcggggcgtcgttcgtttcgttcgtcgtcgttttttcgtttcgcggtgcggggcgtngcgcgttcgcgcgtcgttgggttttcgtgttttcgttcggtttttttcgttcgttcggtttcgtcggtttcgcgtcgttcgtcgttttttcgtcgtttcgcgcgtcgtcgttcgtcggggtttgtcggtttcggtttcggcgcggttttgttcggtntttcgcgtgcgttcgtgtttgcgtcgcgtcgttttttttttttcgttcgcgcgcggcgcgggtcgcggttttcgcgtgtcgttcgttcgttcgttttttttcgtcgtcgttgggtttcgttttcgtcgggttttttnttttcggcgtttnttttttcgttttttttcgcgggtgtcgggcgnggtcgcgttttnttttcggtcgcggcgggngttcgcggttttgggtcgntcgttcgcgntttcggggttgttgttcgtcgcgcgttttttcgttcggcggcgcgcgcgt

SEQ ID NO: 40538 - DNA, 517 bp, Artificial Sequence
  chemically treated genomic DNA (Homo sapiens) CpG-island No: 40538
  misc_feature (51)..(51): n is either a, c, g or t
  misc_feature (61)..(61): n is either a, c, g or t
  misc_feature (80)..(80): n is either a, c, g or t
  misc_feature (98)..(98): n is either a, c, g or t
  misc_feature (110)..(110): n is either a, c, g or t
  misc_feature (142)..(142): n is either a, c, g or t
  misc_feature (155)..(155): n is either a, c, g or t
  misc_feature (292)..(292): n is either a, c, g or t
  misc_feature (449)..(449): n is either a, c, g or t
acgcgcgcgccgccgaacgaaaaaacgcgcgacgaacaacaaccccgaaancgcgaacgancgacccaaaaccgcgaacncccgccgcgaccgaaaanaaaacgcgaccncgcccgacacccgcgaaaaaaaacgaaaaaanaaacgccgaaaanaaaaaacccgacgaaaacgaaacccaacgacgacgaaaaaaaacgaacgaacgaacgacacgcgaaaaccgcgacccgcgccgcgcgcgaacgaaaaaaaaaaaacgacgcgacgcaaacacgaacgcacgcgaaanaccgaacaaaaccgcgccgaaaccgaaaccgacaaaccccgacgaacgacgacgcgcgaaacgacgaaaaaacgacgaacgacgcgaaaccgacgaaaccgaacgaacgaaaaaaaccgaacgaaaacacgaaaacccaacgacgcgcgaacgcgcnacgccccgcaccgcgaaacgaaaaaacgacgacgaacgaaacgaacgacgccccgaaccgcgcaacga

SEQ ID NO: 40539 - DNA, 517 bp, Artificial Sequence
  chemically treated genomic DNA (Homo sapiens) CpG-island No: 40539
  misc_feature (51)..(51): n is either a, c, g or t
  misc_feature (61)..(61): n is either a, c, g or t
  misc_feature (80)..(80): n is either a, c, g or t
  misc_feature (98)..(98): n is either a, c, g or t
  misc_feature (110)..(110): n is either a, c, g or t
  misc_feature (142)..(142): n is either a, c, g or t
  misc_feature (155)..(155): n is either a, c, g or t
  misc_feature (292)..(292): n is either a, c, g or t
  misc_feature (449)..(449): n is either a, c, g or t
acgcgcgcgtcgtcgggcgaggaggcgcgcggcgggtaataatttcgaggncgcgggcggncggtttaaagtcgcgggtnttcgtcgcggtcgggggnaagacgcggttncgttcgatattcgcgggggggggcgggggggnggacgtcgggaanaaggggttcggcgggggcggaatttaacgacggcgaaggagggcggacgggcggacggtacgcgaggatcgcggttcgcgtcgcgcgcgggcgaggggaagaaaacggcgcggcgtaaatacgaacgtacgcggaanatcgggtaagatcgcgtcgggatcggggtcgataaatttcggcgggcggcggcgcgcggggcgacgaaaagacgacgaacggcgcgggatcgacggggtcgggcgagcgggggggatcgggcggggatacggaggtttagcggcgcgcgggcgcgtngcgtttcgtatcgcggagcggagaagcggcggcgggcgaagcgggcgacgtttcggatcgcgtagcgg

SEQ ID NO: 40540 - DNA, 517 bp, Artificial Sequence
  chemically treated genomic DNA (Homo sapiens) CpG-island No: 40540
  misc_feature (69)..(69): n is either a, c, g or t
  misc_feature (226)..(226): n is either a, c, g or t
  misc_feature (363)..(363): n is either a, c, g or t
  misc_feature (376)..(376): n is either a, c, g or t
  misc_feature (408)..(408): n is either a, c, g or t
  misc_feature (420)..(420): n is either a, c, g or t
  misc_feature (438)..(438): n is either a, c, g or t
  misc_feature (457)..(457): n is either a, c, g or t
  misc_feature (467)..(467): n is either a, c, g or t
ccgctacgcgatccgaaacgtcgcccgcttcgcccgccgccgcttctccgctccgcgatacgaaacgcnacgcgcccgcgcgccgctaaacctccgtatccccgcccgatcccccccgctcgcccgaccccgtcgatcccgcgccgttcgtcgtcttttcgtcgccccgcgcgccgccgcccgccgaaatttatcgaccccgatcccgacgcgatcttacccgatnttccgcgtacgttcgtatttacgccgcgccgttttcttcccctcgcccgcgcgcgacgcgaaccgcgatcctcgcgtaccgtccgcccgtccgccctccttcgccgtcgttaaattccgcccccgccgaaccccttnttcccgacgtccncccccccgcccccccccgcgaatatcgaacgnaaccgcgtcttncccccgaccgcgacgaanacccgcgactttaaaccgnccgcccgcgncctcgaaattattacccgccgcgcgcctcctcgcccgacgacgcgcgcgt

SEQ ID NO: 40541 - DNA, 569 bp, Artificial Sequence
  chemically treated genomic DNA (Homo sapiens) CpG-island No: 40541
  misc_feature (50)..(50): n is either a, c, g or t
  misc_feature (513)..(513): n is either a, c, g or t
aacggtgttcgatcgtacgtatataatttagatagtcggcgtgcggacgnttaattaagcggagtcgttacggacggtttacgcgtgtcgtcgttcggtttcgtgcgtgcggcgtgtattttttattttattttttttttttatttattcgttaatttttattattttttttcgtatttcgatatgcgtattcgcgttttattatttacgtaacgtttatcgttattttatttcgtcgggatcggtgcggacgatcgtttcgttttcgttatattttttttttattattataacgttcgttaatttattttttcgttttttcgttcgtaaatttacgtcgtttttttcgtttttattttcgttgtttttacgtatttttcggtttttttttatttcgtcgtaagtttttgatcgtttcggattcgtattttacgtcgcgtattcgtgcggtcgacggttcgttttttttttcgcgcgtttcgttcgtgagtcggggttcgggtagcgattcgntcgttgtgattcgtatttattgcgtcgtatatatacgttttttttcgttattattt

SEQ ID NO: 40542 - DNA, 569 bp, Artificial Sequence
  chemically treated genomic DNA (Homo sapiens) CpG-island No: 40542
  misc_feature (57)..(57): n is either a, c, g or t
  misc_feature (520)..(520): n is either a, c, g or t
aaataataacgaaaaaaaacgtatatatacgacgcaataaatacgaatcacaacgancgaatcgctacccgaaccccgactcacgaacgaaacgcgcgaaaaaaaaaacgaaccgtcgaccgcacgaatacgcgacgtaaaatacgaatccgaaacgatcaaaaacttacgacgaaataaaaaaaaaccgaaaaatacgtaaaaacaacgaaaataaaaacgaaaaaaacgacgtaaatttacgaacgaaaaaacgaaaaaataaattaacgaacgttataataataaaaaaaaaatataacgaaaacgaaacgatcgtccgcaccgatcccgacgaaataaaataacgataaacgttacgtaaataataaaacgcgaatacgcatatcgaaatacgaaaaaaaataataaaaattaacgaataaataaaaaaaaaaaataaaataaaaaatacacgccgcacgcacgaaaccgaacgacgacacgcgtaaaccgtccgtaacgactccgcttaattaancgtccgcacgccgactatctaaattatatacgtacgatcgaacaccgtt

SEQ ID NO: 40543 - DNA, 569 bp, Artificial Sequence
  chemically treated genomic DNA (Homo sapiens) CpG-island No: 40543
  misc_feature (57)..(57): n is either a, c, g or t
  misc_feature (520)..(520): n is either a, c, g or t
ggatggtgacgggggagagcgtatgtgtgcgacgtagtgggtgcgagttataacggncgggtcgttattcggatttcggtttacggacggggcgcgcgaaggaaggggcgagtcgtcgatcgtacggatacgcgacgtgaggtacgggttcggaacgattagaggtttacggcgaaatgagggagaatcggaaaatacgtgagggtaacgggaatgggggcgggagaggcggcgtgggtttgcggacggggagacgagagaatgggttgacgagcgttatgatgatggaggaagggtgtagcgagggcggaacggtcgttcgtatcggtttcgacgggatggagtgacgatagacgttgcgtaggtggtaggacgcgggtacgtatgtcgaggtacggaaggaggtgatagagattgacgggtgagtggggaaagggaatagggtgagaggtatacgtcgtacgtacggagtcgaacgacgatacgcgtgggtcgttcgtggcggtttcgtttaattggncgttcgtacgtcgattgtttgggttgtgtgcgtacgatcgaatatcgtt

SEQ ID NO: 40544 - DNA, 569 bp, Artificial Sequence
  chemically treated genomic DNA (Homo sapiens) CpG-island No: 40544
  misc_feature (50)..(50): n is either a, c, g or t
  misc_feature (513)..(513): n is either a, c, g or t
aacgatattcgatcgtacgcacacaacccaaacaatcgacgtacgaacgnccaattaaacgaaaccgccacgaacgacccacgcgtatcgtcgttcgactccgtacgtacgacgtatacctctcaccctattccctttccccactcacccgtcaatctctatcacctccttccgtacctcgacatacgtacccgcgtcctaccacctacgcaacgtctatcgtcactccatcccgtcgaaaccgatacgaacgaccgttccgccctcgctacacccttcctccatcatcataacgctcgtcaacccattctctcgtctccccgtccgcaaacccacgccgcctctcccgcccccattcccgttaccctcacgtattttccgattctccctcatttcgccgtaaacctctaatcgttccgaacccgtacctcacgtcgcgtatccgtacgatcgacgactcgccccttccttcgcgcgccccgtccgtaaaccgaaatccgaataacgacccgnccgttataactcgcacccactacgtcgcacacatacgctctcccccgtcaccatcc

SEQ ID NO: 40545 - DNA, 968 bp, Artificial Sequence
  chemically treated genomic DNA (Homo sapiens) CpG-island No: 40545
cggggttcgtcggtaatttagtttagtatttttttttttttgcgtttcgcgtcgtttttcgtttttttatttttaagtttttcgtcgagggggaagtcgtttaatttttttttacggtttttgtttcgtcggtttttttttttagtcgattagtggggggtaaggcgaggtttttttaatttaacgaggtttgtggaatttcgtcgtgagagtttttcggtcggttttcgggacgtggggtgcggagaggtcgcgacgcggcgggatagggtaaggtttcggcgaggtgtcgttttaagacgtcgttcgcgttttcgttggggcgcgggttggggtcgttttgggtttcggcgtcgttcgggattggagggcgcgtagcgggtcggcggtttttcggtttttttattcgtttattcgggggcgtattggtatttttaggtttcggtcgcggaggagcgagtttttttcgtttcgtagcgcgatttcgattgggaagtcgcggtaggggtgatggaggagatatttttcgtttgggcggagggaagtcgtcgtatttcgggtagcggggaggggttcggcgttgcgcgagtagggttggttttgttcgatttgggatttttgttgggtaaagtgcggaataggacggggaggagggagcgattcgcgtcgggttaggcgagggcggattggaagtagcggggtttacgcgggagcgttttaaggttttagattataagtcgagttttatcgtttcggtgatgagttcgtattttttttttatttcggatcggttagattttttatttagttttttcggttttgttgatgattcgttgttgattaaaattgttttgggtttagagggtcgcgtacgtttggttattatagttttggggcgaaggaattgggttttatttagttaaattgtttcgcgatttatttttttttttttttttaatttgtatttt

SEQ ID NO: 40546 - DNA, 968 bp, Artificial Sequence
  chemically treated genomic DNA (Homo sapiens) CpG-island No: 40546
aaaatacaaattaaaaaaaaaaaaaaaaataaatcgcgaaacaatttaactaaataaaacccaattccttcgccccaaaactataataaccaaacgtacgcgaccctctaaacccaaaacaattttaatcaacaacgaatcatcaacaaaaccgaaaaaactaaataaaaaatctaaccgatccgaaataaaaaaaaaatacgaactcatcaccgaaacgataaaactcgacttataatctaaaaccttaaaacgctcccgcgtaaaccccgctacttccaatccgccctcgcctaacccgacgcgaatcgctccctcctccccgtcctattccgcactttacccaacaaaaatcccaaatcgaacaaaaccaaccctactcgcgcaacgccgaacccctccccgctacccgaaatacgacgacttccctccgcccaaacgaaaaatatctcctccatcacccctaccgcgacttcccaatcgaaatcgcgctacgaaacgaaaaaaactcgctcctccgcgaccgaaacctaaaaataccaatacgcccccgaataaacgaataaaaaaaccgaaaaaccgccgacccgctacgcgccctccaatcccgaacgacgccgaaacccaaaacgaccccaacccgcgccccaacgaaaacgcgaacgacgtcttaaaacgacacctcgccgaaaccttaccctatcccgccgcgtcgcgacctctccgcaccccacgtcccgaaaaccgaccgaaaaactctcacgacgaaattccacaaacctcgttaaattaaaaaaacctcgccttaccccccactaatcgactaaaaaaaaaaaccgacgaaacaaaaaccgtaaaaaaaaattaaacgacttccccctcgacgaaaaacttaaaaataaaaaaacgaaaaacgacgcgaaacgcaaaaaaaaaaaaatactaaactaaattaccgacgaaccccg

SEQ ID NO: 40547 - DNA, 968 bp, Artificial Sequence
  chemically treated genomic DNA (Homo sapiens) CpG-island No: 40547
gggatgtaggttgaggggaaggaagaaagtaaatcgcggggtagtttgattaagtgaaatttaattttttcgttttaaagttgtggtggttagacgtgcgcgattttttagatttaaaatagttttagttagtaacgggttattagtaggatcgagaagattgggtgggaggtttggtcggttcgaaatagggaagaggtgcgggtttattatcgaggcggtagggttcggtttatggtttagagttttgaggcgttttcgcgtgagtttcgttgtttttagttcgttttcgtttggttcggcgcgggtcgttttttttttttcgttttgtttcgtattttatttagtaggggttttaggtcgagtagggttaattttgttcgcgtagcgtcggattttttttcgttgttcggggtgcggcggttttttttcgtttaaacggggggtgttttttttattatttttgtcgcggttttttagtcggagtcgcgttgcggggcgagggaggttcgttttttcgcggtcggggtttgggggtgttagtgcgttttcgagtgagcgggtagggaagtcgaagagtcgtcgattcgttgcgcgttttttagtttcgggcggcgtcgggatttagagcggttttagttcgcgttttagcggggacgcgaacggcgttttgggacggtatttcgtcggggttttgttttgtttcgtcgcgtcgcggttttttcgtattttacgtttcgggagtcgatcgggagatttttacggcggagttttatagatttcgttaggttaaaggaatttcgttttgttttttattaatcggttagagagggaggtcggcgaaataaaagtcgtagaggaaaattaagcgatttttttttcggcggggaatttggaggtgggggagcggggagcggcgcggggcgtaaggagaaggaagtgttgagttgggttgtcgacgaatttcg

SEQ ID NO: 40548 - DNA, 968 bp, Artificial Sequence
  chemically treated genomic DNA (Homo sapiens) CpG-island No: 40548
cgaaattcgtcgacaacccaactcaacacttccttctccttacgccccgcgccgctccccgctcccccacctccaaattccccgccgaaaaaaaaatcgcttaattttcctctacgacttttatttcgccgacctccctctctaaccgattaataaaaaacaaaacgaaattcctttaacctaacgaaatctataaaactccgccgtaaaaatctcccgatcgactcccgaaacgtaaaatacgaaaaaaccgcgacgcgacgaaacaaaacaaaaccccgacgaaataccgtcccaaaacgccgttcgcgtccccgctaaaacgcgaactaaaaccgctctaaatcccgacgccgcccgaaactaaaaaacgcgcaacgaatcgacgactcttcgacttccctacccgctcactcgaaaacgcactaacacccccaaaccccgaccgcgaaaaaacgaacctccctcgccccgcaacgcgactccgactaaaaaaccgcgacaaaaataataaaaaaaacaccccccgtttaaacgaaaaaaaaccgccgcaccccgaacaacgaaaaaaaatccgacgctacgcgaacaaaattaaccctactcgacctaaaacccctactaaataaaatacgaaacaaaacgaaaaaaaaaaaacgacccgcgccgaaccaaacgaaaacgaactaaaaacaacgaaactcacgcgaaaacgcctcaaaactctaaaccataaaccgaaccctaccgcctcgataataaacccgcacctcttccctatttcgaaccgaccaaacctcccacccaatcttctcgatcctactaataacccgttactaactaaaactattttaaatctaaaaaatcgcgcacgtctaaccaccacaactttaaaacgaaaaaattaaatttcacttaatcaaactaccccgcgatttactttcttccttcccctcaacctacatccc

SEQ ID NO: 40549 - DNA, 566 bp, Artificial Sequence
  chemically treated genomic DNA (Homo sapiens) CpG-island No: 40549
tcgttagtcgttttcgtcggggatgtatttaggtattttttttcggatgcgtgagtggttcgttcgcggatacgttagtttcgtttcgcgagttcggttttttcgtttttttttcgtttacgttttgcgttttttttttattggttttatgtcgcgttttttcgtttaatcgtagcgtttagcgttagaatttgaattttcgttttcgtttgaattgggcgggcgcgtcgggttggaagaaggaagtggagggttgacgttgcgggcgggcgggcgggcgggaggattcgattcggtgggagtcgttagagtcgggcgttcggggacgtagtttgtagggttatcgggttttcgttagaggcggcggcgggagtagcggggattgtaggtcggggtgtagcgaacgtttttcgcgggttgcggttcggtgtgtgcggagcgtggcgggcgtagtttatcgggtcgaggtgagcgcggcgtcggttttttttgcggcggattttgggtgcgatttgacgagcggtggttcgataagtggttttgcgggtcggatcgttttaggtgag

SEQ ID NO: 40550 - DNA, 566 bp, Artificial Sequence
  chemically treated genomic DNA (Homo sapiens) CpG-island No: 40550
ctcacctaaaacgatccgacccgcaaaaccacttatcgaaccaccgctcgtcaaatcgcacccaaaatccgccgcaaaaaaaaccgacgccgcgctcacctcgacccgataaactacgcccgccacgctccgcacacaccgaaccgcaacccgcgaaaaacgttcgctacaccccgacctacaatccccgctactcccgccgccgcctctaacgaaaacccgataaccctacaaactacgtccccgaacgcccgactctaacgactcccaccgaatcgaatcctcccgcccgcccgcccgcccgcaacgtcaaccctccacttccttcttccaacccgacgcgcccgcccaattcaaacgaaaacgaaaattcaaattctaacgctaaacgctacgattaaacgaaaaaacgcgacataaaaccaataaaaaaaaaacgcaaaacgtaaacgaaaaaaaaacgaaaaaaccgaactcgcgaaacgaaactaacgtatccgcgaacgaaccactcacgcatccgaaaaaaaatacctaaatacatccccgacgaaaacgactaacga

SEQ ID NO: 40551 - DNA, 566 bp, Artificial Sequence
  chemically treated genomic DNA (Homo sapiens) CpG-island No: 40551
tttatttgggacgattcggttcgtaaggttatttgtcgaattatcgttcgttaagtcgtatttaaagttcgtcgtaggaggagtcggcgtcgcgtttatttcggttcggtaagttgcgttcgttacgtttcgtatatatcgggtcgtagttcgcggggggcgttcgttgtatttcggtttgtagttttcgttgttttcgtcgtcgtttttgacggggattcggtggttttataggttacgttttcgggcgttcggttttagcggtttttatcgagtcgagttttttcgttcgttcgttcgttcgtagcgttagttttttattttttttttttagttcggcgcgttcgtttaatttaaacgaaaacgaagatttaaattttggcgttaagcgttgcgattgaacgggaaagcgcggtatgggattaataggaagggagcgtagggcgtgggcggggagggggcggggaaatcgggttcgcggggcggggttggcgtgttcgcgggcgagttatttacgtattcggaggaaaatatttgggtgtattttcggcgagggcggttggcgg

SEQ ID NO: 40552 - DNA, 566 bp, Artificial Sequence
  chemically treated genomic DNA (Homo sapiens) CpG-island No: 40552
ccgccaaccgccctcgccgaaaatacacccaaatattttcctccgaatacgtaaataactcgcccgcgaacacgccaaccccgccccgcgaacccgatttccccgccccctccccgcccacgccctacgctcccttcctattaatcccataccgcgctttcccgttcaatcgcaacgcttaacgccaaaatttaaatcttcgttttcgtttaaattaaacgaacgcgccgaactaaaaaaaaaaaataaaaaactaacgctacgaacgaacgaacgaacgaaaaaactcgactcgataaaaaccgctaaaaccgaacgcccgaaaacgtaacctataaaaccaccgaatccccgtcaaaaacgacgacgaaaacaacgaaaactacaaaccgaaatacaacgaacgccccccgcgaactacgacccgatatatacgaaacgtaacgaacgcaacttaccgaaccgaaataaacgcgacgccgactcctcctacgacgaactttaaatacgacttaacgaacgataattcgacaaataaccttacgaaccgaatcgtcccaaataaa

SEQ ID NO: 40553 - DNA, 509 bp, Artificial Sequence
  chemically treated genomic DNA (Homo sapiens) CpG-island No: 40553
gtggagtttttttttttttttttttcgaggacgtaagggcgcgggggttttgattcgtcgttaggtggcgttacgggtttagttatcgcgttttagggtcgcgtgggtttcgtttttgtgatcgacgtgcgggggcgttgcggggcgtcggttggtgtcgcgggtcggggatataggttgggggcgttgtaggtggggcgggttgggggcgttgcggggggcgttgcggggggcgttgcgaggaggcgggttgggggtattgcggagggggcgttgcggagggggtattgcgggaattcgggtagggggcgcgggttggggtgcgggcgggaacgcgggttgtgggcgtttcggagggggcgtttcggaaggggcgttgcggggacgcgggttggggtcgttgcggaggggtcgttgcgtagggggcgcgggcgttcgagttttttttgtgggtttcgtcggcggtagttgacggtggagtttgggtttgcgaaggtgatttgattttt

SEQ ID NO: 40554 - DNA, 509 bp, Artificial Sequence
  chemically treated genomic DNA (Homo sapiens) CpG-island No: 40554
aaaaatcaaatcaccttcgcaaacccaaactccaccgtcaactaccgccgacgaaacccacaaaaaaaactcgaacgcccgcgccccctacgcaacgacccctccgcaacgaccccaacccgcgtccccgcaacgccccttccgaaacgccccctccgaaacgcccacaacccgcgttcccgcccgcaccccaacccgcgccccctacccgaattcccgcaataccccctccgcaacgccccctccgcaatacccccaacccgcctcctcgcaacgccccccgcaacgccccccgcaacgcccccaacccgccccacctacaacgcccccaacctatatccccgacccgcgacaccaaccgacgccccgcaacgcccccgcacgtcgatcacaaaaacgaaacccacgcgaccctaaaacgcgataactaaacccgtaacgccacctaacgacgaatcaaaacccccgcgcccttacgtcctcgaaaaaaaaaaaaaaaaaaactccac

SEQ ID NO: 40555 - DNA, 509 bp, Artificial Sequence
  chemically treated genomic DNA (Homo sapiens) CpG-island No: 40555
aaggattaggttattttcgtaggtttagattttatcgttagttgtcgtcgacggagtttatagaggaggttcgggcgttcgcgttttttgcgtagcggttttttcgtagcggttttagttcgcgttttcgtagcgtttttttcgaagcgtttttttcgaagcgtttatagttcgcgttttcgttcgtattttagttcgcgttttttgttcgggttttcgtagtgtttttttcgtagcgtttttttcgtagtgtttttagttcgttttttcgtagcgtttttcgtagcgtttttcgtagcgtttttagttcgttttatttgtagcgtttttagtttgtgttttcggttcgcgatattagtcggcgtttcgtagcgttttcgtacgtcggttataggagcggagtttacgcggttttggagcgcggtggttgggttcgtagcgttatttggcggcggattagggttttcgcgtttttgcgttttcggaagggggaggggaagggattttat

SEQ ID NO: 40556 - DNA, 509 bp, Artificial Sequence
  chemically treated genomic DNA (Homo sapiens) CpG-island No: 40556
ataaaatcccttcccctcccccttccgaaaacgcaaaaacgcgaaaaccctaatccgccgccaaataacgctacgaacccaaccaccgcgctccaaaaccgcgtaaactccgctcctataaccgacgtacgaaaacgctacgaaacgccgactaatatcgcgaaccgaaaacacaaactaaaaacgctacaaataaaacgaactaaaaacgctacgaaaaacgctacgaaaaacgctacgaaaaaacgaactaaaaacactacgaaaaaaacgctacgaaaaaaacactacgaaaacccgaacaaaaaacgcgaactaaaatacgaacgaaaacgcgaactataaacgcttcgaaaaaaacgcttcgaaaaaaacgctacgaaaacgcgaactaaaaccgctacgaaaaaaccgctacgcaaaaaacgcgaacgcccgaacctcctctataaactccgtcgacgacaactaacgataaaatctaaacctacgaaaataacctaatcctt

SEQ ID NO: 40557 - DNA, 1066 bp, Artificial Sequence
  chemically treated genomic DNA (Homo sapiens) CpG-island No: 40557
tagacggcggacgggaaggattttttttttgttgaagttgcgaagtttgtgtcgattttttattcgtggggttttcggggcgcggggtgcgggtgggttcggggtgttcgtatcggtcggggggaagggtacgcgggttatatttggggggtttgtttttagttagcgcgcgggttaggcggggtgggcgcgcgcgcgtgggggagttttcggtttttgttaggggcggggcgagattaaggcgtcgggtttgtggggaggagtgtaggcgcgcgcgagggcggggggcggttttacgtatcgtgggttttcggcgttgtcgttgcggtcggttcgaggtatcggagatagaatggttgtcggggcgtttttgatcgtcgggcgggcgaggcggggttgatcgtcgtttttttgatcgtttttttttacgttgggcgcgtttatttcggggcgttcgttcggttttcgtttttttgggcgcgcggcgttcggagtcgaggtagttggcgcgggtcgcgggcgaggcggggtcgcgcgcggggttttttttttttttcggttaggtttttttaggagcgtcgggcgtagtttgcgtttttcgtttttcgttttcggtcgggttcgggacgtcgcggttgtggggtcggttcgttaaggataaggtcgggagattgggtggcgatgttcgagtgcgattggaggtagtcgagcggaggcgacggcggttgggatttgttttttttgatcggggagcgggattcggacgggcgtcggtgaggaggaggagaagcggcggcggagaggttttttgcggtcggaattttttttaatagtatttttgtcggcgttcgcgagcgtagtttcgtcgggtaggggcgtcggggaagatggagattgggggtcgggttcgtattggtatttcgtagttagcggtttcgggggtgtggagggttcggtcggcgggcggcggcggcgggggcgtttttttttggttgttggacgggaatagttggttgttgtgttatggttttttttatttggcgttttacgcgtaggtgttttagtt

SEQ ID NO: 40558 - DNA, 1066 bp, Artificial Sequence
  chemically treated genomic DNA (Homo sapiens) CpG-island No: 40558
aactaaaacacctacgcgtaaaacgccaaataaaaaaaaccataacacaacaaccaactattcccgtccaacaaccaaaaaaaaacgcccccgccgccgccgcccgccgaccgaaccctccacacccccgaaaccgctaactacgaaataccaatacgaacccgacccccaatctccatcttccccgacgcccctacccgacgaaactacgctcgcgaacgccgacaaaaatactattaaaaaaaattccgaccgcaaaaaacctctccgccgccgcttctcctcctcctcaccgacgcccgtccgaatcccgctccccgatcaaaaaaaacaaatcccaaccgccgtcgcctccgctcgactacctccaatcgcactcgaacatcgccacccaatctcccgaccttatccttaacgaaccgaccccacaaccgcgacgtcccgaacccgaccgaaaacgaaaaacgaaaaacgcaaactacgcccgacgctcctaaaaaaacctaaccgaaaaaaaaaaaaaaccccgcgcgcgaccccgcctcgcccgcgacccgcgccaactacctcgactccgaacgccgcgcgcccaaaaaaacgaaaaccgaacgaacgccccgaaataaacgcgcccaacgtaaaaaaaaacgatcaaaaaaacgacgatcaaccccgcctcgcccgcccgacgatcaaaaacgccccgacaaccattctatctccgatacctcgaaccgaccgcaacgacaacgccgaaaacccacgatacgtaaaaccgccccccgccctcgcgcgcgcctacactcctccccacaaacccgacgccttaatctcgccccgcccctaacaaaaaccgaaaactcccccacgcgcgcgcgcccaccccgcctaacccgcgcgctaactaaaaacaaaccccccaaatataacccgcgtacccttccccccgaccgatacgaacaccccgaacccacccgcaccccgcgccccgaaaaccccacgaataaaaaatcgacacaaacttcgcaacttcaacaaaaaaaaaatccttcccgtccgccgtcta

SEQ ID NO: 40559 - DNA, 1066 bp, Artificial Sequence
  chemically treated genomic DNA (Homo sapiens) CpG-island No: 40559
gattgggatatttgcgcgtagagcgttaggtagaggaagttatagtatagtagttagttgttttcgtttagtagttaggaggaggcgttttcgtcgtcgtcgttcgtcggtcgagttttttatattttcggggtcgttggttgcggggtattagtgcgggttcggtttttagtttttatttttttcggcgtttttgttcggcgagattgcgttcgcgggcgtcgatagggatgttgttgaagggaatttcggtcgtagaaaattttttcgtcgtcgtttttttttttttttatcggcgttcgttcgagtttcgtttttcggttaggagggatagattttaatcgtcgtcgttttcgttcggttgtttttagtcgtattcgggtatcgttatttagtttttcgattttgtttttagcgggtcgattttatagtcgcggcgtttcggattcggtcggaggcggggagcgggaggcgtagattgcgttcggcgtttttgaggggatttgatcgggaggaggaggggatttcgcgcgcggtttcgtttcgttcgcggttcgcgttaattgtttcggtttcgagcgtcgcgcgtttaggagggcgggggtcgagcgggcgtttcgaagtgggcgcgtttaacgtggaagggggcgattaaggaggcggcggttagtttcgtttcgttcgttcggcggttaagggcgtttcggtagttattttgttttcggtgtttcgagtcggtcgtagcggtagcgtcgggagtttacgatgcgtggggtcgtttttcgttttcgcgcgcgtttatatttttttttataggttcggcgttttggtttcgtttcgtttttgatagggatcggggatttttttacgcgcgcgcgtttatttcgtttggttcgcgcgttgattggagataggttttttaggtgtggttcgcgtgttttttttttcggtcggtgcgggtatttcgggtttattcgtatttcgcgtttcgggagttttacgaatgagagatcgatataggtttcgtagttttagtagaaaagaagtttttttcgttcgtcgtttg

SEQ ID NO: 40560 - DNA, 1066 bp, Artificial Sequence
  chemically treated genomic DNA (Homo sapiens) CpG-island No: 40560
caaacgacgaacgaaaaaaacttcttttctactaaaactacgaaacctatatcgatctctcattcgtaaaactcccgaaacgcgaaatacgaataaacccgaaatacccgcaccgaccgaaaaaaaaaacacgcgaaccacacctaaaaaacctatctccaatcaacgcgcgaaccaaacgaaataaacgcgcgcgcgtaaaaaaatccccgatccctatcaaaaacgaaacgaaaccaaaacgccgaacctataaaaaaaaatataaacgcgcgcgaaaacgaaaaacgaccccacgcatcgtaaactcccgacgctaccgctacgaccgactcgaaacaccgaaaacaaaataactaccgaaacgcccttaaccgccgaacgaacgaaacgaaactaaccgccgcctccttaatcgcccccttccacgttaaacgcgcccacttcgaaacgcccgctcgacccccgccctcctaaacgcgcgacgctcgaaaccgaaacaattaacgcgaaccgcgaacgaaacgaaaccgcgcgcgaaatcccctcctcctcccgatcaaatcccctcaaaaacgccgaacgcaatctacgcctcccgctccccgcctccgaccgaatccgaaacgccgcgactataaaatcgacccgctaaaaacaaaatcgaaaaactaaataacgatacccgaatacgactaaaaacaaccgaacgaaaacgacgacgattaaaatctatccctcctaaccgaaaaacgaaactcgaacgaacgccgataaaaaaaaaaaaaaacgacgacgaaaaaattttctacgaccgaaattcccttcaacaacatccctatcgacgcccgcgaacgcaatctcgccgaacaaaaacgccgaaaaaaataaaaactaaaaaccgaacccgcactaataccccgcaaccaacgaccccgaaaatataaaaaactcgaccgacgaacgacgacgacgaaaacgcctcctcctaactactaaacgaaaacaactaactactatactataacttcctctacctaacgctctacgcgcaaatatcccaatc

SEQ ID NO: 40561 - DNA, 926 bp, Artificial Sequence
  chemically treated genomic DNA (Homo sapiens) CpG-island No: 40561
tcggagaacgtgttggagtcgttggggatggtagatacgggttttgattttacgttcgacgtgcgcgcgcgtttggtcgcgggtttttacgtgtagcgggcggtcggcgttattttatgatttgggtttggtatcggtcgtcgggttagattgtattttatttgcgtcgatttggttaagttggcgtggcgtttttggtgcggcgggtttcggcggtttttgcggtcgacgcggtaagacgttgttggcgtcgttgttggtttgttcgggcgtttatttcgttaacgagacgggtacgtcgtgggagttttacgcgtagcggggttatcgcgtggtgcgtaaggacggcgatttggacggttacgtcgttattttttcgttggtgttttcgttgcgtttgggtttggtgttgttgttggtagggttacggtcgttcgggttcgatttggtggcgcgggtttacgatgagtttttgttcgttttggagcgcgtttttcgggaggtcgagttcggttcggtttcgtcgtttatcgcgtattttttcgtcggttattttattttcgttaatttgattttttacgaggtgcgcgtcgggtcggcgggcgagttgcgtttgcgttagttcgggtcgcgcgtggaggcgttggtgtttttagcgtttcgtattttggcgttgcgttatttgtacggtcgcgttttttagttgtacgtggtttacgagtttttttgcgtattgttattcggcgacgcgtggttttcgttcgaggtttagtacgggtagttggttaatttttattttttggattattacgggttgttattcggtttcgacgtgttcggttttaatacgtatagagtgttgcggttgcggggtaagtcggtgtttaagatttagtgatttcgggttttgtttggattttttgttt

SEQ ID NO: 40562 - DNA, 926 bp, Artificial Sequence
  chemically treated genomic DNA (Homo sapiens) CpG-island No: 40562
aaacaaaaaatccaaacaaaacccgaaatcactaaatcttaaacaccgacttaccccgcaaccgcaacactctatacgtattaaaaccgaacacgtcgaaaccgaataacaacccgtaataatccaaaaaataaaaattaaccaactacccgtactaaacctcgaacgaaaaccacgcgtcgccgaataacaatacgcaaaaaaactcgtaaaccacgtacaactaaaaaacgcgaccgtacaaataacgcaacgccaaaatacgaaacgctaaaaacaccaacgcctccacgcgcgacccgaactaacgcaaacgcaactcgcccgccgacccgacgcgcacctcgtaaaaaatcaaattaacgaaaataaaataaccgacgaaaaaatacgcgataaacgacgaaaccgaaccgaactcgacctcccgaaaaacgcgctccaaaacgaacaaaaactcatcgtaaacccgcgccaccaaatcgaacccgaacgaccgtaaccctaccaacaacaacaccaaacccaaacgcaacgaaaacaccaacgaaaaaataacgacgtaaccgtccaaatcgccgtccttacgcaccacgcgataaccccgctacgcgtaaaactcccacgacgtacccgtctcgttaacgaaataaacgcccgaacaaaccaacaacgacgccaacaacgtcttaccgcgtcgaccgcaaaaaccgccgaaacccgccgcaccaaaaacgccacgccaacttaaccaaatcgacgcaaataaaatacaatctaacccgacgaccgataccaaacccaaatcataaaataacgccgaccgcccgctacacgtaaaaacccgcgaccaaacgcgcgcgcacgtcgaacgtaaaatcaaaacccgtatctaccatccccaacgactccaacacgttctccga

SEQ ID NO: 40563 - DNA, 926 bp, Artificial Sequence
  chemically treated genomic DNA (Homo sapiens) CpG-island No: 40563
ggatagggggtttaggtagagttcggggttattgggttttgaatatcggtttgtttcgtagtcgtagtattttgtacgtgttgaggtcgggtacgtcgaagtcgggtgatagttcgtggtgatttaaggggtagaagttgattagttgttcgtgttgggtttcgagcgagagttacgcgtcgtcgagtggtagtgcgtaggggaattcgtgggttacgtgtagttggaagacgcggtcgtgtaggtggcgtagcgttagggtgcggaacgttggaggtattagcgtttttacgcgcggttcgaattggcgtaggcgtagttcgttcgtcggttcggcgcgtatttcgtagaaggttaggttggcgaaggtgaagtagtcggcgaaggggtgcgcggtgggcggcggagtcgggtcgggttcggtttttcggagggcgcgttttagggcgggtaggagtttatcgtaggttcgcgttattaggtcgggttcgggcggtcgtggttttgttagtagtagtattaggtttagacgtagcgggggtattagcgagaaggtggcggcgtagtcgtttagatcgtcgtttttgcgtattacgcggtagtttcgttgcgcgtggaatttttacggcgtgttcgtttcgttggcgaagtaggcgttcgggtaggttagtagcggcgttagtagcgttttgtcgcgtcggtcgtaggagtcgtcggggttcgtcgtattaggagcgttacgttagtttggttaggtcggcgtaggtagagtataatttggttcgacggtcggtattaagtttaggttatagagtggcgtcggtcgttcgttgtacgtagaagttcgcggttaggcgcgcgcgtacgtcgggcgtgaggttaaagttcgtgtttgttatttttagcggttttagtacgtttttcga

SEQ ID NO: 40564 - DNA, 926 bp, Artificial Sequence
  chemically treated genomic DNA (Homo sapiens) CpG-island No: 40564
tcgaaaaacgtactaaaaccgctaaaaataacaaacacgaactttaacctcacgcccgacgtacgcgcgcgcctaaccgcgaacttctacgtacaacgaacgaccgacgccactctataacctaaacttaataccgaccgtcgaaccaaattatactctacctacgccgacctaaccaaactaacgtaacgctcctaatacgacgaaccccgacgactcctacgaccgacgcgacaaaacgctactaacgccgctactaacctacccgaacgcctacttcgccaacgaaacgaacacgccgtaaaaattccacgcgcaacgaaactaccgcgtaatacgcaaaaacgacgatctaaacgactacgccgccaccttctcgctaatacccccgctacgtctaaacctaatactactactaacaaaaccacgaccgcccgaacccgacctaataacgcgaacctacgataaactcctacccgccctaaaacgcgccctccgaaaaaccgaacccgacccgactccgccgcccaccgcgcaccccttcgccgactacttcaccttcgccaacctaaccttctacgaaatacgcgccgaaccgacgaacgaactacgcctacgccaattcgaaccgcgcgtaaaaacgctaatacctccaacgttccgcaccctaacgctacgccacctacacgaccgcgtcttccaactacacgtaacccacgaattcccctacgcactaccactcgacgacgcgtaactctcgctcgaaacccaacacgaacaactaatcaacttctaccccttaaatcaccacgaactatcacccgacttcgacgtacccgacctcaacacgtacaaaatactacgactacgaaacaaaccgatattcaaaacccaataaccccgaactctacctaaaccccctatcc

SEQ ID NO: 40565 - DNA, 662 bp, Artificial Sequence
  chemically treated genomic DNA (Homo sapiens) CpG-island No: 40565
cgcgcgggtgttagtggagaggtcgggagggttcggaagaaaaacgttcggtttattggagtcggagacgtagttatttatttagtagtagtagtttaagtttacggcgcgcgttttttttgtttcgacgaagttgtcgttcgattttcgcgttgatgcgttgcgattttttttttttcgcggataggtagtagtagtcggttatggtgcgtttagtttagtattcgacggggcgacgcggtttcgggtattcgaattttcggttcggtcgtttattcggttagtatgcgacgggtataggggtgtggaaagaaaagacgggggtcgatttgagttttggagtaagacgtttggattttcgaggtttaattttttttcgaaagtcggttttgaggcggggtgaatgtcgagcgttgggaacgttcgagtgtatttcggattcgggtttagttcgttttattttcgttttggggaggaggagggcgagtttataagttgggagcgttgttggttttgggaagatgcgcgcgttttttggtataggagtcggatagtagtcgggggcgtatacgagttggaacgtcggtgttttggggagagtaggattttttgggtttaggggtgtttttaggcggtaggtaggtacggagtgggttggaggt

SEQ ID NO: 40566 - DNA, 662 bp, Artificial Sequence
  chemically treated genomic DNA (Homo sapiens) CpG-island No: 40566
acctccaacccactccgtacctacctaccgcctaaaaacacccctaaacccaaaaaatcctactctccccaaaacaccgacgttccaactcgtatacgcccccgactactatccgactcctataccaaaaaacgcgcgcatcttcccaaaaccaacaacgctcccaacttataaactcgccctcctcctccccaaaacgaaaataaaacgaactaaacccgaatccgaaatacactcgaacgttcccaacgctcgacattcaccccgcctcaaaaccgactttcgaaaaaaaattaaacctcgaaaatccaaacgtcttactccaaaactcaaatcgacccccgtcttttctttccacacccctatacccgtcgcatactaaccgaataaacgaccgaaccgaaaattcgaatacccgaaaccgcgtcgccccgtcgaatactaaactaaacgcaccataaccgactactactacctatccgcgaaaaaaaaaaaatcgcaacgcatcaacgcgaaaatcgaacgacaacttcgtcgaaacaaaaaaaacgcgcgccgtaaacttaaactactactactaaataaataactacgtctccgactccaataaaccgaacgtttttcttccgaaccctcccgacctctccactaacacccgcgcg

SEQ ID NO: 40567 - DNA, 662 bp, Artificial Sequence
  chemically treated genomic DNA (Homo sapiens) CpG-island No: 40567
gtttttaatttatttcgtgtttatttgtcgtttggggatatttttaggtttaggagattttattttttttagagtatcgacgttttaattcgtatgcgttttcgattgttgttcggtttttgtgttaaggggcgcgcgtatttttttagggttagtaacgtttttaatttgtggattcgttttttttttttttagagcgagagtggggcgggttgagttcggattcggggtgtattcgagcgtttttagcgttcggtatttatttcgttttagagtcgattttcgaagggggattgagtttcggaggtttaggcgttttattttaaagtttaagtcggttttcgttttttttttttatatttttgtgttcgtcgtatgttggtcgggtgagcggtcgggtcgaggattcgggtgttcggggtcgcgtcgtttcgtcgggtattgagttgagcgtattatggtcggttgttgttgtttgttcgcggaggagaaggagtcgtagcgtattagcgcggagatcgagcgatagtttcgtcgggataagaaggacgcgcgtcgtgagtttaagttgttgttgttgggtgagtggttgcgttttcgattttagtgagtcgggcgtttttttttcgagttttttcggtttttttattggtattcgcgcg

SEQ ID NO: 40568 - DNA, 662 bp, Artificial Sequence
  chemically treated genomic DNA (Homo sapiens) CpG-island No: 40568
cgcgcgaataccaataaaaaaaccgaaaaaactcgaaaaaaaaacgcccgactcactaaaatcgaaaacgcaaccactcacccaacaacaacaacttaaactcacgacgcgcgtccttcttatcccgacgaaactatcgctcgatctccgcgctaatacgctacgactccttctcctccgcgaacaaacaacaacaaccgaccataatacgctcaactcaatacccgacgaaacgacgcgaccccgaacacccgaatcctcgacccgaccgctcacccgaccaacatacgacgaacacaaaaatataaaaaaaaaaaacgaaaaccgacttaaactttaaaataaaacgcctaaacctccgaaactcaatcccccttcgaaaatcgactctaaaacgaaataaataccgaacgctaaaaacgctcgaatacaccccgaatccgaactcaacccgccccactctcgctctaaaaaaaaaaaaaacgaatccacaaattaaaaacgttactaaccctaaaaaaatacgcgcgccccttaacacaaaaaccgaacaacaatcgaaaacgcatacgaattaaaacgtcgatactctaaaaaaaataaaatctcctaaacctaaaaatatccccaaacgacaaataaacacgaaataaattaaaaac

SEQ ID NO: 40569 - DNA, 750 bp, Artificial Sequence
  chemically treated genomic DNA (Homo sapiens) CpG-island No: 40569
ttggttcgcgcgtggaggacggagtttagtatggattcgtgtaggagttcgtagtttatttattcgtttacgatggtatttatttgtttcggtaattttatagtttttattggtttcggtaggacgtgtattcggttttttagttcgttgaatcgtattatttttcgggtttgttgttagatggcgttggtttttatcgcgtatacgcgtcgggtttcggtttgggtatagaagatgtttagaatgtcggtgttcgcgtttacgtttagtatcgttttgtttcgtagtgttgtttagtttcgaaggatatttaggcggtaggtatcggtgcggacgcggttcgcgattattttttcgtggatcgaaacgttcgagtagtattcgtagtatagttggtttcgttttcgtttagtttttcggggtcgttttagggtcgtttttcgtttcgcgttatttttttttttagtttttttttttttttcgtcgtcgtttttcgatttaagttttttttttttgggttgcgatattttggtcgttttgttcggttttcggcgggcgtagcgcggtacggcgcgggttatagaaaacgggggtttttgggatttgaagtgcgcgttcgttttttttatttttgtaggggtcgttcggtcggcggcgcggaaggttttttgtgtttgtttacgggagttgttttgtattgtttttttggtgttttggtatttttttttttatttacgacgtttatatttt

SEQ ID NO: 40570 - DNA, 750 bp, Artificial Sequence
  chemically treated genomic DNA (Homo sapiens) CpG-island No: 40570
aaaatataaacgtcgtaaataaaaaaaaaaataccaaaacaccaaaaaaacaatacaaaacaactcccgtaaacaaacacaaaaaaccttccgcgccgccgaccgaacgacccctacaaaaataaaaaaaacgaacgcgcacttcaaatcccaaaaacccccgttttctataacccgcgccgtaccgcgctacgcccgccgaaaaccgaacaaaacgaccaaaatatcgcaacccaaaaaaaaaaaacttaaatcgaaaaacgacgacgaaaaaaaaaaaaaaactaaaaaaaaaaataacgcgaaacgaaaaacgaccctaaaacgaccccgaaaaactaaacgaaaacgaaaccaactatactacgaatactactcgaacgtttcgatccacgaaaaaataatcgcgaaccgcgtccgcaccgatacctaccgcctaaatatccttcgaaactaaacaacactacgaaacaaaacgatactaaacgtaaacgcgaacaccgacattctaaacatcttctatacccaaaccgaaacccgacgcgtatacgcgataaaaaccaacgccatctaacaacaaacccgaaaaataatacgattcaacgaactaaaaaaccgaatacacgtcctaccgaaaccaataaaaactataaaattaccgaaacaaataaataccatcgtaaacgaataaataaactacgaactcctacacgaatccatactaaactccgtcctccacgcgcgaaccaa

SEQ ID NO: 40571 - DNA, 750 bp, Artificial Sequence
  chemically treated genomic DNA (Homo sapiens) CpG-island No: 40571
agaatgtgggcgtcgtgggtgggaaaagggatgttaggatattagaagagtaatataaaatagttttcgtgagtaggtataggagatttttcgcgtcgtcggtcgggcgatttttgtagaagtaggaaggacgagcgcgtattttaagttttagaagttttcgttttttgtagttcgcgtcgtgtcgcgttacgttcgtcgggagtcgggtagagcggttaagatgtcgtagtttaagaaaagaaagtttgagtcggggggcggcggcgaaggaggggagggaattgaagaggaagatggcgcggagcgggaggcggttttggagcgatttcggaggattaagcgggaacgggattagttgtattacgagtgttattcggacgtttcggtttacgaggagatgatcgcggatcgcgttcgtatcgatgtttatcgtttgggtatttttcggaattgggtagtattgcgaggtaagacggtattggacgtgggcgcgggtatcggtattttgagtattttttgtgtttaggtcggggttcggcgcgtgtacgcggtagaggttagcgttatttggtaataggttcgggaggtggtgcggtttaacgggttggaggatcgggtgtacgttttgtcgggattagtggagattgtagagttgtcggaataggtggatgttatcgtgagcgagtggatgggttacggatttttgtacgagtttatgttgagtttcgttttttacgcgcgaattaa

SEQ ID NO: 40572 - DNA, 750 bp, Artificial Sequence
  chemically treated genomic DNA (Homo sapiens) CpG-island No: 40572
ttaattcgcgcgtaaaaaacgaaactcaacataaactcgtacaaaaatccgtaacccatccactcgctcacgataacatccacctattccgacaactctacaatctccactaatcccgacaaaacgtacacccgatcctccaacccgttaaaccgcaccacctcccgaacctattaccaaataacgctaacctctaccgcgtacacgcgccgaaccccgacctaaacacaaaaaatactcaaaataccgatacccgcgcccacgtccaataccgtcttacctcgcaatactacccaattccgaaaaatacccaaacgataaacatcgatacgaacgcgatccgcgatcatctcctcgtaaaccgaaacgtccgaataacactcgtaatacaactaatcccgttcccgcttaatcctccgaaatcgctccaaaaccgcctcccgctccgcgccatcttcctcttcaattccctcccctccttcgccgccgccccccgactcaaactttcttttcttaaactacgacatcttaaccgctctacccgactcccgacgaacgtaacgcgacacgacgcgaactacaaaaaacgaaaacttctaaaacttaaaatacgcgctcgtccttcctacttctacaaaaatcgcccgaccgacgacgcgaaaaatctcctatacctactcacgaaaactattttatattactcttctaatatcctaacatcccttttcccacccacgacgcccacattct

SEQ ID NO: 40573 - DNA, 654 bp, Artificial Sequence
  chemically treated genomic DNA (Homo sapiens) CpG-island No: 40573
gttttcgattcgggtcgtagtttacgtttcgcgtttttttttgcgcgtcgttttgtttttttttagtttcgtttttagtttcgttcgggcgtttagagggtaaatgaggggcggcggggtggcgggtggggggtagacgcggaattttttagcgcgggggttttggtttattttgtaatcgggtagtttttttttgtttacggagagaaaggggaaatggaaaagtcggggaggcggtggttggcgttcgttgcgtcgtttttgggtaggtttagacgtcgtgagttaggggtagagtagggcggtttgagcgtgcgggcgacgcgggttttattcgttcgtttcgttttggattgcgcgttacgttttggggttcggcgttttggtttttgtttttgtcgttgtcgtcgtcggattttagtggttcggcgtgttcggtttttataggtttgtagttagtatcgtatcgaattttcggggggtcgcggttggagcgttcgttcggtatgggaagcgtaaagttcgtaggtaatttagggttgggggttttcggcgtgtttttcgggtcgcgtttcgtttgggtgtttcggggatttttatgtagaaatggagggtgtttttagtagaggggaaaattttggcgtgggaagaggt

SEQ ID NO: 40574 - DNA, 654 bp, Artificial Sequence
  chemically treated genomic DNA (Homo sapiens) CpG-island No: 40574
acctcttcccacgccaaaattttcccctctactaaaaacaccctccatttctacataaaaatccccgaaacacccaaacgaaacgcgacccgaaaaacacgccgaaaacccccaaccctaaattacctacgaactttacgcttcccataccgaacgaacgctccaaccgcgaccccccgaaaattcgatacgatactaactacaaacctataaaaaccgaacacgccgaaccactaaaatccgacgacgacaacgacaaaaacaaaaaccaaaacgccgaaccccaaaacgtaacgcgcaatccaaaacgaaacgaacgaataaaacccgcgtcgcccgcacgctcaaaccgccctactctacccctaactcacgacgtctaaacctacccaaaaacgacgcaacgaacgccaaccaccgcctccccgacttttccatttcccctttctctccgtaaacaaaaaaaaactacccgattacaaaataaaccaaaacccccgcgctaaaaaattccgcgtctaccccccacccgccaccccgccgcccctcatttaccctctaaacgcccgaacgaaactaaaaacgaaactaaaaaaaaacaaaacgacgcgcaaaaaaaaacgcgaaacgtaaactacgacccgaatcgaaaac

SEQ ID NO: 40575 - DNA, 654 bp, Artificial Sequence
  chemically treated genomic DNA (Homo sapiens) CpG-island No: 40575
atttttttttacgttagagtttttttttttgttgggggtattttttatttttgtatgggaattttcggggtatttaggcgggacgcgattcgaaagatacgtcggagatttttaattttggattatttgcgggttttgcgttttttatgtcgggcgagcgttttagtcgcggtttttcgaaggttcggtgcgatgttggttgtaggtttgtgggagtcgagtacgtcgggttattgggattcggcggcggtagcggtagaagtaggaattagggcgtcggattttagagcgtggcgcgtagtttagagcggagcggacgagtgagattcgcgtcgttcgtacgtttagatcgttttgttttgtttttgatttacggcgtttgagtttgtttaggggcggcgtagcggacgttagttatcgttttttcgatttttttatttttttttttttttcgtaaatagaaagagattgttcggttgtagggtaagttagagttttcgcgttgggaaatttcgcgtttgttttttattcgttatttcgtcgttttttatttgttttttgggcgttcgggcggagttggaggcgggattagggaggagtagagcggcgcgtagggaggagcgcggaacgtgagttgcggttcgaatcgagagt

SEQ ID NO: 40576 - DNA, 654 bp, Artificial Sequence
  chemically treated genomic DNA (Homo sapiens) CpG-island No: 40576
actctcgattcgaaccgcaactcacgttccgcgctcctccctacgcgccgctctactcctccctaatcccgcctccaactccgcccgaacgcccaaaaaacaaataaaaaacgacgaaataacgaataaaaaacaaacgcgaaatttcccaacgcgaaaactctaacttaccctacaaccgaacaatctctttctatttacgaaaaaaaaaaaaaaataaaaaaatcgaaaaaacgataactaacgtccgctacgccgcccctaaacaaactcaaacgccgtaaatcaaaaacaaaacaaaacgatctaaacgtacgaacgacgcgaatctcactcgtccgctccgctctaaactacgcgccacgctctaaaatccgacgccctaattcctacttctaccgctaccgccgccgaatcccaataacccgacgtactcgactcccacaaacctacaaccaacatcgcaccgaaccttcgaaaaaccgcgactaaaacgctcgcccgacataaaaaacgcaaaacccgcaaataatccaaaattaaaaatctccgacgtatctttcgaatcgcgtcccgcctaaataccccgaaaattcccatacaaaaataaaaaatacccccaacaaaaaaaaaaactctaacgtaaaaaaaaat

SEQ ID NO: 40577 - DNA, 525 bp, Artificial Sequence
  chemically treated genomic DNA (Homo sapiens) CpG-island No: 40577
gaggtcgtcgtcggttatatttacgaggtttttagggcgtcggcggcgagatttcggtcggttagggggtcgggttgtggttgaggtgggacgagttagggtcggggaggagatacggcgttaaaagagggtagttgcgggttcggtaggattttcgtcgtcgatttattttatttatttcgcgtcgtttatttttcgttgtttacgtcgcgttttatatcgcgggttttagagtttgaggaaagtaacggggtaggcgcggattagggcgggttttattgcgtttgcggaagcgggcggggaggggcgggtcgacgtttattgcgtttgcggaaaggggcggggtaggtataggtttgcgggtgttatttattgcgtttgcggaaaggggcggggcgggcgcgggttggcgggcggtgtttattgcgtttgcggaaaggggcggggtaggcgcgagaagggagtcgagttgggggcggcgtttagggcggggtggcgggcggagtttattgcgtttgtgcgagg

SEQ ID NO: 40578 - DNA, 525 bp, Artificial Sequence
  chemically treated genomic DNA (Homo sapiens) CpG-island No: 40578
cctcgcacaaacgcaataaactccgcccgccaccccgccctaaacgccgcccccaactcgactcccttctcgcgcctaccccgcccctttccgcaaacgcaataaacaccgcccgccaacccgcgcccgccccgcccctttccgcaaacgcaataaataacacccgcaaacctatacctaccccgcccctttccgcaaacgcaataaacgtcgacccgcccctccccgcccgcttccgcaaacgcaataaaacccgccctaatccgcgcctaccccgttactttcctcaaactctaaaacccgcgatataaaacgcgacgtaaacaacgaaaaataaacgacgcgaaataaataaaataaatcgacgacgaaaatcctaccgaacccgcaactaccctcttttaacgccgtatctcctccccgaccctaactcgtcccacctcaaccacaacccgaccccctaaccgaccgaaatctcgccgccgacgccctaaaaacctcgtaaatataaccgacgacgacctc

SEQ ID NO: 40579 - DNA, 525 bp, Artificial Sequence
  chemically treated genomic DNA (Homo sapiens) CpG-island No: 40579
tttcgtataggcgtagtaggtttcgttcgttatttcgttttggacgtcgtttttagttcggtttttttttcgcgtttgtttcgttttttttcgtaggcgtagtaggtatcgttcgttagttcgcgttcgtttcgttttttttcgtaggcgtagtaggtggtattcgtaggtttgtgtttgtttcgttttttttcgtaggcgtagtgagcgtcgattcgttttttttcgttcgttttcgtaggcgtagtaggattcgttttggttcgcgtttgtttcgttgttttttttaggttttaaggttcgcggtgtggagcgcggcgtaggtagcggggagtgggcggcgcggggtgggtggagtgggtcggcggcggggattttgtcgagttcgtagttgtttttttttagcgtcgtgtttttttttcggttttggttcgttttattttagttatagttcggttttttggtcggtcgaggtttcgtcgtcggcgttttggggatttcgtgggtgtggtcggcggcgatttt

SEQ ID NO: 40580 - DNA, 525 bp, Artificial Sequence
  chemically treated genomic DNA (Homo sapiens) CpG-island No: 40580
aaaatcgccgccgaccacacccacgaaatccccaaaacgccgacgacgaaacctcgaccgaccaaaaaaccgaactataactaaaataaaacgaaccaaaaccgaaaaaaaaacacgacgctaaaaaaaaacaactacgaactcgacaaaatccccgccgccgacccactccacccaccccgcgccgcccactccccgctacctacgccgcgctccacaccgcgaaccttaaaacctaaaaaaaacaacgaaacaaacgcgaaccaaaacgaatcctactacgcctacgaaaacgaacgaaaaaaaacgaatcgacgctcactacgcctacgaaaaaaaacgaaacaaacacaaacctacgaataccacctactacgcctacgaaaaaaaacgaaacgaacgcgaactaacgaacgatacctactacgcctacgaaaaaaaacgaaacaaacgcgaaaaaaaaaccgaactaaaaacgacgtccaaaacgaaataacgaacgaaacctactacgcctatacgaaa

SEQ ID NO: 40581 - DNA, 649 bp, Artificial Sequence
  chemically treated genomic DNA (Homo sapiens) CpG-island No: 40581
ttggaagtcggtttagtgcggagatcgcgatcggaggagcgtagaacgttttttttagcgttttgggtttcgtaggtataatttttaaattagcggcgaaattcgagtttcgtcgtttttcggggagggagcgtggtcgtttagtcgagttttttttttggtttcgttcgtttttgcgtcgcgaggtcgtttggtgagttttagggttttgtggttttttagtcgtcggcgttttcgggtgttttttggtcgcggtaggaacggagttgggcgtttagacggcgtcggggtcgtttttgtgttttcgttcggtggtcggagtcgtagttttgttttttttttattggggtagcgtttgtttttttcgcggtcggatcgcgtcggagttttaggttttaggtagttcgggtcgtagttgttatggagaagttcggcgcgtatttggggtgttcggtaggagtttcggtcgtttcgcgtttttttttttatttacgattgtggtcggcggcggtttttgtttttcggataaagttggagatgttgttgcggagtcggttttgggatttgtttttttttttggtttcggggttcgtagtcgtcggggttcggaagggtttttcggggcgtttttttaggagcggtggttagg

SEQ ID NO: 40582 - DNA, 649 bp, Artificial Sequence
  chemically treated genomic DNA (Homo sapiens) CpG-island No: 40582
cctaaccaccgctcctaaaaaaacgccccgaaaaacccttccgaaccccgacgactacgaaccccgaaaccaaaaaaaaaaacaaatcccaaaaccgactccgcaacaacatctccaactttatccgaaaaacaaaaaccgccgccgaccacaatcgtaaataaaaaaaaaaacgcgaaacgaccgaaactcctaccgaacaccccaaatacgcgccgaacttctccataacaactacgacccgaactacctaaaacctaaaactccgacgcgatccgaccgcgaaaaaaacaaacgctaccccaataaaaaaaaaacaaaactacgactccgaccaccgaacgaaaacacaaaaacgaccccgacgccgtctaaacgcccaactccgttcctaccgcgaccaaaaaacacccgaaaacgccgacgactaaaaaaccacaaaaccctaaaactcaccaaacgacctcgcgacgcaaaaacgaacgaaaccaaaaaaaaaactcgactaaacgaccacgctccctccccgaaaaacgacgaaactcgaatttcgccgctaatttaaaaattatacctacgaaacccaaaacgctaaaaaaaacgttctacgctcctccgatcgcgatctccgcactaaaccgacttccaa

SEQ ID NO: 40583 - DNA, 649 bp, Artificial Sequence
  chemically treated genomic DNA (Homo sapiens) CpG-island No: 40583
tttggttatcgtttttgagggaacgtttcggggagttttttcgggtttcgacggttgcgggtttcggagttaagagaagaagtaggttttagggtcgatttcgtagtagtatttttagttttgttcgggaagtagaggtcgtcgtcggttatagtcgtgggtgagaagaagggcgcgaggcggtcggggtttttgtcgggtattttaagtacgcgtcgggtttttttatgatagttgcggttcgggttgtttggggtttgggatttcggcgcggttcggtcgcgagaaaggtaggcgttgttttagtggggaaggggtaaggttgcggtttcggttatcgggcgggggtatagaaacgatttcggcgtcgtttgagcgtttagtttcgtttttgtcgcggttaaaagatattcgagagcgtcggcggttgggggattatagggttttggaatttattaggcggtttcgcggcgtaaaagcgggcggagttagagaaggggttcggttaggcggttacgtttttttttcggagggcggcgggattcggatttcgtcgttggtttaaaaattgtgtttgcggagtttaggacgttgggaggagcgttttgcgttttttcggtcgcggttttcgtattaaatcgatttttag

SEQ ID NO: 40584 - DNA, 649 bp, Artificial Sequence
  chemically treated genomic DNA (Homo sapiens) CpG-island No: 40584
ctaaaaatcgatttaatacgaaaaccgcgaccgaaaaaacgcaaaacgctcctcccaacgtcctaaactccgcaaacacaatttttaaaccaacgacgaaatccgaatcccgccgccctccgaaaaaaaaacgtaaccgcctaaccgaaccccttctctaactccgcccgcttttacgccgcgaaaccgcctaataaattccaaaaccctataatcccccaaccgccgacgctctcgaatatcttttaaccgcgacaaaaacgaaactaaacgctcaaacgacgccgaaatcgtttctatacccccgcccgataaccgaaaccgcaaccttaccccttccccactaaaacaacgcctacctttctcgcgaccgaaccgcgccgaaatcccaaaccccaaacaacccgaaccgcaactatcataaaaaaacccgacgcgtacttaaaatacccgacaaaaaccccgaccgcctcgcgcccttcttctcacccacgactataaccgacgacgacctctacttcccgaacaaaactaaaaatactactacgaaatcgaccctaaaacctacttcttctcttaactccgaaacccgcaaccgtcgaaacccgaaaaaactccccgaaacgttccctcaaaaacgataaccaaa

SEQ ID NO: 40585 - DNA, 594 bp, Artificial Sequence
  chemically treated genomic DNA (Homo sapiens) CpG-island No: 40585
  misc_feature (174)..(174): n is either a, c, g or t
  misc_feature (190)..(190): n is either a, c, g or t
ggacgtcggaggattgcgttgtagatgtaagtgtgcggaagagcgtcgttgaattaagcggagttcgggcgcgttggatttttagtattggcgcggtcgcgttattaaaatatcgtagtgaagatttagtttttatgagaagagatcgcgcgatataatcggttgtttttaatntgcgcgcgcgttcgtngtagcgaagtaattcgacgatagtacgatgttagtcgtcgacgggacgtggttcggattcgtttttcgttattcgcgttatcgcgtttcggttcgcgtgaatagtcggcggtttatacgtatacgtttgtcgagcgtcgtgtcgcgtaaagttcgtgatcggtgcgatgatgtaattttcgacgcggttgtggcgtgttaggtgttaagagcgggttatagtcgtattttcgcgtattatgtggtggcggcgagttgtcgcgggtttcgaagtcgagtcgtcgcgcgcgacgggatttcggcggagtatttcgagatacgtcgaataatgtcgaagcgataagtcggaacggtgtcgtttagtcgggattcggggacgtatgtgtcgcgtcgcgcgtttttttt

SEQ ID NO: 40586 - DNA, 594 bp, Artificial Sequence
  chemically treated genomic DNA (Homo sapiens) CpG-island No: 40586
  misc_feature (405)..(405): n is either a, c, g or t
  misc_feature (421)..(421): n is either a, c, g or t
aaaaaaaacgcgcgacgcgacacatacgtccccgaatcccgactaaacgacaccgttccgacttatcgcttcgacattattcgacgtatctcgaaatactccgccgaaatcccgtcgcgcgcgacgactcgacttcgaaacccgcgacaactcgccgccaccacataatacgcgaaaatacgactataacccgctcttaacacctaacacgccacaaccgcgtcgaaaattacatcatcgcaccgatcacgaactttacgcgacacgacgctcgacaaacgtatacgtataaaccgccgactattcacgcgaaccgaaacgcgataacgcgaataacgaaaaacgaatccgaaccacgtcccgtcgacgactaacatcgtactatcgtcgaattacttcgctacnacgaacgcgcgcgcanattaaaaacaaccgattatatcgcgcgatctcttctcataaaaactaaatcttcactacgatattttaataacgcgaccgcgccaatactaaaaatccaacgcgcccgaactccgcttaattcaacgacgctcttccgcacacttacatctacaacgcaatcctccgacgtcc

SEQ ID NO: 40587 - DNA, 594 bp, Artificial Sequence
  chemically treated genomic DNA (Homo sapiens) CpG-island No: 40587
  misc_feature (405)..(405): n is either a, c, g or t
  misc_feature (421)..(421): n is either a, c, g or t
gggggggacgcgcggcgcgatatatgcgttttcgagtttcggttgggcggtatcgtttcgatttatcgtttcggtattgttcggcgtatttcggggtatttcgtcgggatttcgtcgcgcgcggcggttcgatttcgggattcgcgataattcgtcgttattatatgatacgcggggatgcggttataattcgtttttaatatttggtacgttatagtcgcgtcggggattgtattatcgtatcggttacgggttttacgcggtacggcgttcgataagcgtgtgcgtgtagatcgtcggttgtttacgcgggtcggggcgcggtggcgcggataacggggggcgaattcgggttacgtttcgtcggcgattagtatcgtgttatcgtcgaattgtttcgttatngcgggcgcgcgcgtanattaggaatagtcggttatgtcgcgcggtttttttttatgggagttggatttttattgcgatgttttggtggcgcggtcgcgttaatattaggaatttagcgcgttcgggtttcgtttggtttaacgacgttttttcgtatatttgtatttgtagcgtaatttttcggcgttt

SEQ ID NO: 40588 - DNA, 594 bp, Artificial Sequence
  chemically treated genomic DNA (Homo sapiens) CpG-island No: 40588
  misc_feature (174)..(174): n is either a, c, g or t
  misc_feature (190)..(190): n is either a, c, g or t
aaacgccgaaaaattacgctacaaatacaaatatacgaaaaaacgtcgttaaaccaaacgaaacccgaacgcgctaaattcctaatattaacgcgaccgcgccaccaaaacatcgcaataaaaatccaactcccataaaaaaaaaccgcgcgacataaccgactattcctaatntacgcgcgcgcccgcnataacgaaacaattcgacgataacacgatactaatcgccgacgaaacgtaacccgaattcgccccccgttatccgcgccaccgcgccccgacccgcgtaaacaaccgacgatctacacgcacacgcttatcgaacgccgtaccgcgtaaaacccgtaaccgatacgataatacaatccccgacgcgactataacgtaccaaatattaaaaacgaattataaccgcatccccgcgtatcatataataacgacgaattatcgcgaatcccgaaatcgaaccgccgcgcgcgacgaaatcccgacgaaataccccgaaatacgccgaacaataccgaaacgataaatcgaaacgataccgcccaaccgaaactcgaaaacgcatatatcgcgccgcgcgtccccccc

SEQ ID NO: 40589 - DNA, 709 bp, Artificial Sequence
  chemically treated genomic DNA (Homo sapiens) CpG-island No: 40589
ttgcgtgataaaggtggagattaaggatttgaacgataatgcgtttagtttttcggtagtatagatcgagttggagatttcggaggtagttagttttggtacgcgtatttcgttggatagcgtttacgatttagatttaggaagttttggcgtgtagatttacgagtttacgtttaacgagttgttcggtttggagattaagacgcgcggcgacggttttcgttttgtcgaattcgtggtggaaaagagtttggatcgcgagacgtagtcgtattatagttttcgaattattgcgttagacggtggcgattcgtcgcgtttgggtatcgttggttttagtattaaggtgatcgattttaatgataataattcggtgtttagcgagtttatttacgcggtgagcgtgttagaaaattcgttttttaatatattcgttattcgttttaacgttagcgatttagacgagggtattaacggttaggtggtttattttttttatggttacgttaacgatcgtacgcgcgagtttttttagatcgattcgtatagtggtttggttattgttattggcgttttagattacgaagaggggtacgtgtacgaattggacgtgtaggttaaggatttggggtttaattttatttcggtatattgtaaggttatcgttagcgtgttggatattaatgataattcgtcggttattaatttg

SEQ ID NO: 40590 - DNA, 709 bp, Artificial Sequence
  chemically treated genomic DNA (Homo sapiens) CpG-island No: 40590
caaattaataaccgacgaattatcattaatatccaacacgctaacgataaccttacaatataccgaaataaaattaaaccccaaatccttaacctacacgtccaattcgtacacgtacccctcttcgtaatctaaaacgccaataacaataaccaaaccactatacgaatcgatctaaaaaaactcgcgcgtacgatcgttaacgtaaccataaaaaaaataaaccacctaaccgttaataccctcgtctaaatcgctaacgttaaaacgaataacgaatatattaaaaaacgaattttctaacacgctcaccgcgtaaataaactcgctaaacaccgaattattatcattaaaatcgatcaccttaatactaaaaccaacgatacccaaacgcgacgaatcgccaccgtctaacgcaataattcgaaaactataatacgactacgtctcgcgatccaaactcttttccaccacgaattcgacaaaacgaaaaccgtcgccgcgcgtcttaatctccaaaccgaacaactcgttaaacgtaaactcgtaaatctacacgccaaaacttcctaaatctaaatcgtaaacgctatccaacgaaatacgcgtaccaaaactaactacctccgaaatctccaactcgatctatactaccgaaaaactaaacgcattatcgttcaaatccttaatctccacctttatcacgcaa

SEQ ID NO: 40591 - DNA, 709 bp, Artificial Sequence
  chemically treated genomic DNA (Homo sapiens) CpG-island No: 40591
taggttgatgatcggcggattgttattggtgtttagtacgttgacggtgattttgtagtgtgtcgggatggaattgggttttaagtttttagtttgtacgtttagttcgtatacgtgttttttttcgtagtttaaagcgttagtgatagtgattaggttattgtgcgggtcgatttgaaagagttcgcgcgtgcggtcgttgacgtagttatagaaggagtagattatttggtcgttggtgttttcgtttggatcgttggcgttgaggcggatgacgggtgtgttgggaggcgagttttttggtacgtttatcgcgtaggtggattcgttaaatatcgggttgttgttattggagtcggttattttgatattaaggttaacggtgtttaggcgcggcgggtcgttatcgtttagcgtagtgattcggaagttgtagtgcgattgcgtttcgcggtttaggtttttttttattacgagttcggtaaagcgggagtcgtcgtcgcgcgttttgatttttaggtcgaatagttcgttgggcgtgagttcgtaagtttgtacgttaaagttttttgagtttggatcgtaagcgttgtttagcgggatgcgcgtgttagggttggttgttttcgagatttttagttcgatttgtgttgtcgggaaattgggcgtattgtcgtttaggtttttgatttttatttttattacgtag

SEQ ID NO: 40592 - DNA, 709 bp, Artificial Sequence
  chemically treated genomic DNA (Homo sapiens) CpG-island No: 40592
ctacgtaataaaaataaaaatcaaaaacctaaacgacaatacgcccaatttcccgacaacacaaatcgaactaaaaatctcgaaaacaaccaaccctaacacgcgcatcccgctaaacaacgcttacgatccaaactcaaaaaactttaacgtacaaacttacgaactcacgcccaacgaactattcgacctaaaaatcaaaacgcgcgacgacgactcccgctttaccgaactcgtaataaaaaaaaacctaaaccgcgaaacgcaatcgcactacaacttccgaatcactacgctaaacgataacgacccgccgcgcctaaacaccgttaaccttaatatcaaaataaccgactccaataacaacaacccgatatttaacgaatccacctacgcgataaacgtaccaaaaaactcgcctcccaacacacccgtcatccgcctcaacgccaacgatccaaacgaaaacaccaacgaccaaataatctactccttctataactacgtcaacgaccgcacgcgcgaactctttcaaatcgacccgcacaataacctaatcactatcactaacgctttaaactacgaaaaaaaacacgtatacgaactaaacgtacaaactaaaaacttaaaacccaattccatcccgacacactacaaaatcaccgtcaacgtactaaacaccaataacaatccgccgatcatcaaccta

SEQ ID NO: 40593 - DNA, 552 bp, Artificial Sequence
  chemically treated genomic DNA (Homo sapiens) CpG-island No: 40593
agcgacggcggtagagaaagcgtgggagcgacgtttttgttttggacgtcgacgtgtttacgtcgaggtcgcgtttagattcggaggcggggtcgttacgtggggtagcgtgggtcgttgttttggaaacgtagagcgcgcgttttaggtaaaggttgttacgtttaggatagggtttttacggtggaggaaaggatttttgcgggatattacgttgtgcgttaaaaagtcgggcggtttcggagttagagtagcggttttgcggcgtaggcggcgggtcggggtagttttgaagtcgggattcggttcgaagggtgagtattagttcgttttcggtgggcgtcgtttttaatgttaagttttagggtagtcgtttggattcgtttggcgagcgcggagtgagcggcgtaggaggagtttttttaggtttcggaagaaagtcggtttttgtttcgcgcggttagcgatatttagagcgagattgtttgggtttgggaggaggtaggtagcgaatttaatttgtatagtggggttttgtgtgcgtttttagtg

SEQ ID NO: 40594 - DNA, 552 bp, Artificial Sequence
  chemically treated genomic DNA (Homo sapiens) CpG-island No: 40594
cactaaaaacgcacacaaaaccccactatacaaattaaattcgctacctacctcctcccaaacccaaacaatctcgctctaaatatcgctaaccgcgcgaaacaaaaaccgactttcttccgaaacctaaaaaaactcctcctacgccgctcactccgcgctcgccaaacgaatccaaacgactaccctaaaacttaacattaaaaacgacgcccaccgaaaacgaactaatactcacccttcgaaccgaatcccgacttcaaaactaccccgacccgccgcctacgccgcaaaaccgctactctaactccgaaaccgcccgactttttaacgcacaacgtaatatcccgcaaaaatcctttcctccaccgtaaaaaccctatcctaaacgtaacaacctttacctaaaacgcgcgctctacgtttccaaaacaacgacccacgctaccccacgtaacgaccccgcctccgaatctaaacgcgacctcgacgtaaacacgtcgacgtccaaaacaaaaacgtcgctcccacgctttctctaccgccgtcgct

SEQ ID NO: 40595 - DNA, 552 bp, Artificial Sequence
  chemically treated genomic DNA (Homo sapiens) CpG-island No: 40595
tattgagagcgtatataagattttattgtataagttgggttcgttgtttgtttttttttaggtttaaataatttcgttttgagtgtcgttggtcgcgcggagtaggggtcggttttttttcgggatttaggggagttttttttgcgtcgtttatttcgcgttcgttaaacgggtttaagcgattgttttggaatttgatattgaaggcggcgtttatcggagacgagttggtgtttatttttcgggtcggatttcggttttaaggttgtttcgattcgtcgtttgcgtcgtagagtcgttgttttggtttcgaagtcgttcggttttttggcgtatagcgtggtatttcgtagaagtttttttttttatcgtgagaattttgttttgggcgtagtagtttttatttggagcgcgcgttttgcgtttttaaggtagcggtttacgttgttttacgtgacggtttcgttttcgggtttgggcgcggtttcgacgtgggtacgtcggcgtttagagtaagagcgtcgtttttacgttttttttgtcgtcgtcgtt

SEQ ID NO: 40596 - DNA, 552 bp, Artificial Sequence
  chemically treated genomic DNA (Homo sapiens) CpG-island No: 40596
aacgacgacgacaaaaaaaacgtaaaaacgacgctcttactctaaacgccgacgtacccacgtcgaaaccgcgcccaaacccgaaaacgaaaccgtcacgtaaaacaacgtaaaccgctaccttaaaaacgcaaaacgcgcgctccaaataaaaactactacgcccaaaacaaaattctcacgataaaaaaaaaaacttctacgaaataccacgctatacgccaaaaaaccgaacgacttcgaaaccaaaacaacgactctacgacgcaaacgacgaatcgaaacaaccttaaaaccgaaatccgacccgaaaaataaacaccaactcgtctccgataaacgccgccttcaatatcaaattccaaaacaatcgcttaaacccgtttaacgaacgcgaaataaacgacgcaaaaaaaactcccctaaatcccgaaaaaaaaccgacccctactccgcgcgaccaacgacactcaaaacgaaattatttaaacctaaaaaaaaacaaacaacgaacccaacttatacaataaaatcttatatacgctctcaata

SEQ ID NO: 40597 - DNA, 508 bp, Artificial Sequence
  chemically treated genomic DNA (Homo sapiens) CpG-island No: 40597
gtttttttcgtgtttagtttttacggttattttcgtcgacgacgtcgtcgtcgtagggtttttttcgttttcgtttttgtagtcgcggtttttcggcggaagttttttattttttgtggttttcgtagcggtcgtcgagattttcgcgttggtcgcggtttcgcggagaagtttcggggcgtcgcgcgcgttattgagtatgttcggatcgttcgcgtagattcgttggtttcgtcggcgtgttattcgcgtcgttagtgggagggtatagttgggtgggaggagatggaaaagtaaggtaagttcgggggagttgtttaggttgttaatttgtcgagtgggcggtcgtaaaaggcgcgcggggggcgggaatgattcgtttttgattggttttttttgtgtgcgcgagtttcgcgtaggtacgagttagtgcgtttttttattatatagagatagaggttgataagggatggggttcgagtttttagaatatttgaggataggtcgt

SEQ ID NO: 40598 - DNA, 508 bp, Artificial Sequence
  chemically treated genomic DNA (Homo sapiens) CpG-island No: 40598
acgacctatcctcaaatattctaaaaactcgaaccccatcccttatcaacctctatctctatataataaaaaaacgcactaactcgtacctacgcgaaactcgcgcacacaaaaaaaaccaatcaaaaacgaatcattcccgccccccgcgcgccttttacgaccgcccactcgacaaattaacaacctaaacaactcccccgaacttaccttacttttccatctcctcccacccaactataccctcccactaacgacgcgaataacacgccgacgaaaccaacgaatctacgcgaacgatccgaacatactcaataacgcgcgcgacgccccgaaacttctccgcgaaaccgcgaccaacgcgaaaatctcgacgaccgctacgaaaaccacaaaaaataaaaaacttccgccgaaaaaccgcgactacaaaaacgaaaacgaaaaaaaccctacgacgacgacgtcgtcgacgaaaataaccgtaaaaactaaacacgaaaaaaac

SEQ ID NO: 40599 - DNA, 508 bp, Artificial Sequence
  chemically treated genomic DNA (Homo sapiens) CpG-island No: 40599
gcgatttgtttttaggtgttttaggaattcgggttttattttttgttagtttttgtttttgtgtggtgagaaggcgtattggttcgtgtttgcgcgaaattcgcgtatatagaaaagattaattaaggacgggttattttcgtttttcgcgcgttttttgcgatcgtttattcgataggttgataatttagatagttttttcggatttgttttatttttttatttttttttatttagttatatttttttattggcggcgcggatggtacgtcggcggagttagcgagtttgcgcgagcggttcgagtatgtttaatagcgcgcgcggcgtttcggagttttttcgcggaatcgcgattaacgcggaggtttcggcggtcgttgcgggagttataggaagtgaagagttttcgtcgggagatcgcggttgtaggaacggaggcggaaggggttttgcggcgacgacgtcgtcgacgggggtggtcgtgggagttgagtacggagaagat

SEQ ID NO: 40600 - DNA, 508 bp, Artificial Sequence
  chemically treated genomic DNA (Homo sapiens) CpG-island No: 40600
atcttctccgtactcaactcccacgaccacccccgtcgacgacgtcgtcgccgcaaaaccccttccgcctccgttcctacaaccgcgatctcccgacgaaaactcttcacttcctataactcccgcaacgaccgccgaaacctccgcgttaatcgcgattccgcgaaaaaactccgaaacgccgcgcgcgctattaaacatactcgaaccgctcgcgcaaactcgctaactccgccgacgtaccatccgcgccgccaataaaaaaatataactaaataaaaaaaaataaaaaaataaaacaaatccgaaaaaactatctaaattatcaacctatcgaataaacgatcgcaaaaaacgcgcgaaaaacgaaaataacccgtccttaattaatcttttctatatacgcgaatttcgcgcaaacacgaaccaatacgccttctcaccacacaaaaacaaaaactaacaaaaaataaaacccgaattcctaaaacacctaaaaacaaatcgc

SEQ ID NO: 40601 - DNA, 517 bp, Artificial Sequence
  chemically treated genomic DNA (Homo sapiens) CpG-island No: 40601
  misc_feature (44)..(44): n is either a, c, g or t
tttttttcgtttttggtgtttttgtgttgttcgcgcggttttgnggcggggtcggcgtttcgtcgcggtcgggtgtttttcgtggcgtcgggcgttggttcgggttcgttcgtcggcggtggttcgttttcgtgggtcgcgcgcgggtttcggcgttcgtttggttcgtttgcggtcgcgttttcgcgttttgcgtttgttttttttcggtcgttgtttcgttttgttttgtttcgttttatcgtttgtcgtttattcgcgcgcggtcgcgttggcggtgttcgtgtttttatcgtttcgttcgtttttttttgtgggtgtttgtgtcgttaggtatcgttgttgttttgttgtttcgtttcgcgttggtttcggtcggtgttgtgatgatcgtaacgttcgttcgcgttcgttggttttagcgcgttcgaacgttcgttggatcggtgtggcgttcgtcgttttttcgtcgtgttcgttattacgcgcgcgtggtcgtttgtattggcgtatgcgt

SEQ ID NO: 40602 - DNA, 517 bp, Artificial Sequence
  chemically treated genomic DNA (Homo sapiens) CpG-island No: 40602
  misc_feature (474)..(474): n is either a, c, g or t
acgcatacgccaatacaaacgaccacgcgcgcgtaataacgaacacgacgaaaaaacgacgaacgccacaccgatccaacgaacgttcgaacgcgctaaaaccaacgaacgcgaacgaacgttacgatcatcacaacaccgaccgaaaccaacgcgaaacgaaacaacaaaacaacaacgatacctaacgacacaaacacccacaaaaaaaaacgaacgaaacgataaaaacacgaacaccgccaacgcgaccgcgcgcgaataaacgacaaacgataaaacgaaacaaaacaaaacgaaacaacgaccgaaaaaaaacaaacgcaaaacgcgaaaacgcgaccgcaaacgaaccaaacgaacgccgaaacccgcgcgcgacccacgaaaacgaaccaccgccgacgaacgaacccgaaccaacgcccgacgccacgaaaaacacccgaccgcgacgaaacgccgaccccgccncaaaaccgcgcgaacaacacaaaaacaccaaaaacgaaaaaaa

SEQ ID NO: 40603 - DNA, 517 bp, Artificial Sequence
  chemically treated genomic DNA (Homo sapiens) CpG-island No: 40603
  misc_feature (474)..(474): n is either a, c, g or t
acgtatacgttagtgtagacggttacgcgcgcgtgatggcggatacgacgagaaaacggcgggcgttatatcgatttagcgggcgttcgggcgcgttgaggttaacggacgcgagcgggcgttacgattattataatatcggtcgaagttaacgcgaagcggaatagtaagatagtaacggtgtttagcgatatagatatttataagagaagacgaacgaaacggtaggaatacggatatcgttagcgcggtcgcgcgcgagtgggcgataggcggtaaggcgaggtaggataagacggggtaacgatcggaagagggtaggcgtaagacgcgaaaacgcggtcgtaggcgggttaggcgggcgtcgggattcgcgcgcggtttacggaggcggattatcgtcggcgagcgggttcggattagcgttcggcgttacgagagatattcgatcgcggcgggacgtcgatttcgttntaaagtcgcgcgagtagtataaaaatattaggggcgggaggaa

SEQ ID NO: 40604 - DNA, 517 bp, Artificial Sequence
  chemically treated genomic DNA (Homo sapiens) CpG-island No: 40604
  misc_feature (44)..(44): n is either a, c, g or t
ttcctcccgcccctaatatttttatactactcgcgcgactttanaacgaaatcgacgtcccgccgcgatcgaatatctctcgtaacgccgaacgctaatccgaacccgctcgccgacgataatccgcctccgtaaaccgcgcgcgaatcccgacgcccgcctaacccgcctacgaccgcgttttcgcgtcttacgcctaccctcttccgatcgttaccccgtcttatcctacctcgccttaccgcctatcgcccactcgcgcgcgaccgcgctaacgatatccgtattcctaccgtttcgttcgtcttctcttataaatatctatatcgctaaacaccgttactatcttactattccgcttcgcgttaacttcgaccgatattataataatcgtaacgcccgctcgcgtccgttaacctcaacgcgcccgaacgcccgctaaatcgatataacgcccgccgttttctcgtcgtatccgccatcacgcgcgcgtaaccgtctacactaacgtatacgt

SEQ ID NO: 40605 - DNA, 1092 bp, Artificial Sequence
  chemically treated genomic DNA (Homo sapiens) CpG-island No: 40605
ggcggaatcgttcgggcggaattaacgggttgtcgcggggggtggggttacggtttttttttttttgtttttagtggaacggtttcggcggaattaacgggttacggggatgtattacgcgtatcgtcgttttttttttttgtttgtagtggaacggttcgggcggaattaacgtgcggtcgttcggagtattcggcgcgtcgtgttttttttcgtgtggttgtattgtaacggttcgggttggattattaggcggtagcggagaggtatttaaaagtttcgtgttattttagattttaaaaaaaaaaaaaaaattgcgtgtttttattttcgtcggtttgtagtggaagggttcgagtagaattaacgggggaggggacgttgagcgcgtcgtgttttttttttcgtttgtttggagtagaacggttcgggcggaattaacgggtagtcgcgggggcgttgtgggtcgcggcgcgttttttcggtttcgtggttttggggtattgaggagcggcgttcgcggggtagcgaggagttcgatgtagggttttgcgcgttattttcggtttcgcgggcgtttcgtgaagtttatttggattcgttagcgttgtgttattttttagtgtcgagtttcgagttgttttcgcggtttcgcgttcggtttttttatcgcgcgttttttaggtttcgttcgttagcgtttttttgttgtgaaggcgtcggggtttagcgttatgtttgcggcggagattgtattaggttttcggtgggttttgcgtgcggggtgttttgttcggtgatcggtgttgggtgttgcgtgttcggtgttcggtgttgggtgttgggtgtcggtattgatgttgagtgtgcgggcgttcggggtttttttgttcggattcgtttttgggggtttttttttatggttggcgttgtgcgcggaaaacgttggtggggtttttttagttggttttaagcgtttttacgttcgggagtttacggcgatttttacgttttgaagtttgggaacgcggtgtgcgtggtcgtaaaaagaataataataataaaaaaatataaaataaaatacgtaaaaaa

SEQ ID NO: 40606 - DNA, 1092 bp, Artificial Sequence
  chemically treated genomic DNA (Homo sapiens) CpG-island No: 40606
ttttttacgtattttattttatatttttttattattattattctttttacgaccacgcacaccgcgttcccaaacttcaaaacgtaaaaatcgccgtaaactcccgaacgtaaaaacgcttaaaaccaactaaaaaaaccccaccaacgttttccgcgcacaacgccaaccataaaaaaaaacccccaaaaacgaatccgaacaaaaaaaccccgaacgcccgcacactcaacatcaataccgacacccaacacccaacaccgaacaccgaacacgcaacacccaacaccgatcaccgaacaaaacaccccgcacgcaaaacccaccgaaaacctaatacaatctccgccgcaaacataacgctaaaccccgacgccttcacaacaaaaaaacgctaacgaacgaaacctaaaaaacgcgcgataaaaaaaccgaacgcgaaaccgcgaaaacaactcgaaactcgacactaaaaaataacacaacgctaacgaatccaaataaacttcacgaaacgcccgcgaaaccgaaaataacgcgcaaaaccctacatcgaactcctcgctaccccgcgaacgccgctcctcaataccccaaaaccacgaaaccgaaaaaacgcgccgcgacccacaacgcccccgcgactacccgttaattccgcccgaaccgttctactccaaacaaacgaaaaaaaaaacacgacgcgctcaacgtcccctcccccgttaattctactcgaacccttccactacaaaccgacgaaaataaaaacacgcaattttttttttttttttaaaatctaaaataacacgaaacttttaaatacctctccgctaccgcctaataatccaacccgaaccgttacaatacaaccacacgaaaaaaaacacgacgcgccgaatactccgaacgaccgcacgttaattccgcccgaaccgttccactacaaacaaaaaaaaaaaacgacgatacgcgtaatacatccccgtaacccgttaattccgccgaaaccgttccactaaaaacaaaaaaaaaaaaaccgtaaccccaccccccgcgacaacccgttaattccgcccgaacgattccgcc

SEQ ID NO: 40607 - DNA, 1092 bp, Artificial Sequence
  chemically treated genomic DNA (Homo sapiens) CpG-island No: 40607
ttttttgcgtgttttgttttgtgtttttttgttgttgttgttttttttgcggttacgtatatcgcgtttttaggttttagggcgtgggggtcgtcgtggattttcggacgtgaaaacgtttaaagttagttgggaaaattttattagcgtttttcgcgtatagcgttagttataggaaaggatttttaggagcgaattcgggtagggaaatttcggacgttcgtatatttagtattagtatcggtatttagtatttagtatcgagtatcgagtacgtagtatttagtatcgattatcgagtagagtatttcgtacgtagaatttatcgagagtttgatgtagttttcgtcgtaggtatagcgttaggtttcggcgtttttataataaagggacgttggcgggcggggtttgagaggcgcgcggtggaggggtcgggcgcgaggtcgcggagatagttcggagttcggtattggggagtggtatagcgttggcggatttaggtgggttttacggggcgttcgcgggatcggaaatgacgcgtagaattttgtatcgggtttttcgttgtttcgcgggcgtcgttttttagtgttttagagttacggagtcggggaaacgcgtcgcggtttataacgttttcgcggttgttcgttggtttcgttcgggtcgttttattttaggtagacgggaggagaaatacggcgcgtttagcgttttttttttcgttggttttgttcgggtttttttattgtaggtcgacgggggtggaaatacgtagttttttttttttttttaaggtttagggtaatacggggtttttaagtgttttttcgttgtcgtttggtggtttagttcgggtcgttgtagtgtagttatacggggagggatacggcgcgtcgagtgtttcgggcggtcgtacgttggtttcgttcgggtcgttttattgtaggtagagggagaggacgacggtgcgcgtagtgtattttcgtggttcgttggtttcgtcggggtcgttttattgaaggtagaaggggggggatcgtggttttatttttcgcggtagttcgttggtttcgttcgggcggtttcgtt

SEQ ID NO: 40608 - DNA, 1092 bp, Artificial Sequence
  chemically treated genomic DNA (Homo sapiens) CpG-island No: 40608
aacgaaaccgcccgaacgaaaccaacgaactaccgcgaaaaataaaaccacgatccccccccttctaccttcaataaaacgaccccgacgaaaccaacgaaccacgaaaatacactacgcgcaccgtcgtcctctccctctacctacaataaaacgacccgaacgaaaccaacgtacgaccgcccgaaacactcgacgcgccgtatccctccccgtataactacactacaacgacccgaactaaaccaccaaacgacaacgaaaaaacacttaaaaaccccgtattaccctaaaccttaaaaaaaaaaaaaaaactacgtatttccacccccgtcgacctacaataaaaaaacccgaacaaaaccaacgaaaaaaaaaacgctaaacgcgccgtatttctcctcccgtctacctaaaataaaacgacccgaacgaaaccaacgaacaaccgcgaaaacgttataaaccgcgacgcgtttccccgactccgtaactctaaaacactaaaaaacgacgcccgcgaaacaacgaaaaacccgatacaaaattctacgcgtcatttccgatcccgcgaacgccccgtaaaacccacctaaatccgccaacgctataccactccccaataccgaactccgaactatctccgcgacctcgcgcccgacccctccaccgcgcgcctctcaaaccccgcccgccaacgtccctttattataaaaacgccgaaacctaacgctatacctacgacgaaaactacatcaaactctcgataaattctacgtacgaaatactctactcgataatcgatactaaatactacgtactcgatactcgatactaaatactaaataccgatactaatactaaatatacgaacgtccgaaatttccctacccgaattcgctcctaaaaatcctttcctataactaacgctatacgcgaaaaacgctaataaaattttcccaactaactttaaacgttttcacgtccgaaaatccacgacgacccccacgccctaaaacctaaaaacgcgatatacgtaaccgcaaaaaaaacaacaacaacaaaaaaacacaaaacaaaacacgcaaaaaa

SEQ ID NO: 40609 - DNA, 670 bp, Artificial Sequence
  chemically treated genomic DNA (Homo sapiens) CpG-island No: 40609
ggatttttttcgttttagttttttgggtacgtcggtttgggtatttttatttattatagagttcgtagtatgtagttttttgaggacgttgttgttcgtcgtttgggttttttcgttttttttagcgcgtggtcgttaatttatattgacgtttcggttagggttttcgttcgcgttcgttatttgaggtttcgcgatcgggtcgtcgggtcgtacgtagtagattaggtagagcggggtgcgcgtcgttcgtgttaggtagtagagttcgtaacggaaatttttgatgtagttaagcgagtttaggatgattacgtcgtggcgatttaggcgtcgttttacggaggttcgtagagttttacgtaatgtttttttacgggtagaatcgtcgtatatcgttgggttttttgcgtttaggatagttgcgtcgtttattacgtatatcgcgcggttttcggtagttagcgttacgcgtaattttttagtacgtcggtttttgtcgttgtacggtagttcgtaaaatattacgagcggtatttttttagggagcgattattggtaatcgcgttgcgttaattttcgggttgtacgtattttcgacgtaagtcggaagtgtaaattgttttttttgttttttttgatttttatagatttttttgtttttatggaa

SEQ ID NO: 40610 - DNA, 670 bp, Artificial Sequence
  chemically treated genomic DNA (Homo sapiens) CpG-island No: 40610
ttccataaaaacaaaaaaatctataaaaatcaaaaaaaacaaaaaaaacaatttacacttccgacttacgtcgaaaatacgtacaacccgaaaattaacgcaacgcgattaccaataatcgctccctaaaaaaataccgctcgtaatattttacgaactaccgtacaacgacaaaaaccgacgtactaaaaaattacgcgtaacgctaactaccgaaaaccgcgcgatatacgtaataaacgacgcaactatcctaaacgcaaaaaacccaacgatatacgacgattctacccgtaaaaaaacattacgtaaaactctacgaacctccgtaaaacgacgcctaaatcgccacgacgtaatcatcctaaactcgcttaactacatcaaaaatttccgttacgaactctactacctaacacgaacgacgcgcaccccgctctacctaatctactacgtacgacccgacgacccgatcgcgaaacctcaaataacgaacgcgaacgaaaaccctaaccgaaacgtcaatataaattaacgaccacgcgctaaaaaaaacgaaaaaacccaaacgacgaacaacaacgtcctcaaaaaactacatactacgaactctataataaataaaaatacccaaaccgacgtacccaaaaaactaaaacgaaaaaaatcc

SEQ ID NO: 40611 - DNA, 670 bp, Artificial Sequence
  chemically treated genomic DNA (Homo sapiens) CpG-island No: 40611
ttttatagaaataagagggtttgtaaaagttaagggagataggaagagtagtttgtattttcggtttacgtcggagatgcgtataattcggaagttggcgtagcgcggttgttaatggtcgttttttgagaggatgtcgttcgtggtgttttgcgggttgtcgtatagcggtaagagtcggcgtgttgaagagttgcgcgtggcgttggttgtcgagggtcgcgcggtgtacgtggtggacgacgtagttgttttgggcgtagaggatttagcggtgtacggcgattttgttcgtgagaaggtattgcgtggagttttgcgagttttcgtggaacggcgtttgagtcgttacgacgtggttattttggattcgtttaattatattaaaggttttcgttacgagttttattgtttggtacgggcggcgcgtatttcgttttgtttggtttattgcgtacggttcggcggttcgatcgcgggattttaggtggcgggcgcgaacgagaattttggtcggaacgttagtgtgagttggcggttacgcgttgaggaggacgggagagtttaggcggcgggtagtagcgtttttagggaattgtatattgcggattttgtagtaaatggaagtgtttaggtcgacgtatttaaggaattggagcgagaagaattt

SEQ ID NO: 40612 - DNA, 670 bp, Artificial Sequence
  chemically treated genomic DNA (Homo sapiens) CpG-island No: 40612
aaattcttctcgctccaattccttaaatacgtcgacctaaacacttccatttactacaaaatccgcaatatacaattccctaaaaacgctactacccgccgcctaaactctcccgtcctcctcaacgcgtaaccgccaactcacactaacgttccgaccaaaattctcgttcgcgcccgccacctaaaatcccgcgatcgaaccgccgaaccgtacgcaataaaccaaacaaaacgaaatacgcgccgcccgtaccaaacaataaaactcgtaacgaaaacctttaatataattaaacgaatccaaaataaccacgtcgtaacgactcaaacgccgttccacgaaaactcgcaaaactccacgcaataccttctcacgaacaaaatcgccgtacaccgctaaatcctctacgcccaaaacaactacgtcgtccaccacgtacaccgcgcgaccctcgacaaccaacgccacgcgcaactcttcaacacgccgactcttaccgctatacgacaacccgcaaaacaccacgaacgacatcctctcaaaaaacgaccattaacaaccgcgctacgccaacttccgaattatacgcatctccgacgtaaaccgaaaatacaaactactcttcctatctcccttaacttttacaaaccctcttatttctataaaa

SEQ ID NO: 40613 - DNA, 666 bp, Artificial Sequence
  chemically treated genomic DNA (Homo sapiens) CpG-island No: 40613
ggttcgtagtttaatttattcgcgttttttgggtcgaatcggttcgtagtcgagtttttcgtttaggcggattcgaattaggtgcgttcgtagtatatttttttttcgttatcgtttatttttcgtattttatcgttttcgaaatttatttagcgtagataattgaatattcggggttttgggggttacgttttttagtatattttttttttttttcgttaagggtagaaatagacgtattttttagaaaagtaattttttttgcgttatcgtcgtttttgtcggtcgttatttttttttttttacgtcgttttttttttaatttatggtttatatcgtcgtcgtgttcgtcgggatgaggggtcgcgtcggaggagggtagacgtcgtagggttgcgggtttcgggtttagtcgttaggcgggttgcgtttttacgtttagacgggtttatataaaggtaggttaggcgcgttcgggtttgttcgcgggttggcgggtagcgaggttcgcggttcgagttttttaggttttttcgggggaacgcgatcggcgacgacgacgacggcgtttttcgggttcggtttttttcggtttacgattttttatttatcgtttatttaggttgtttgagaaattttttttagtcgtgggtttttaagaaagga

SEQ ID NO: 40614 - DNA, 666 bp, Artificial Sequence
  chemically treated genomic DNA (Homo sapiens) CpG-island No: 40614
tcctttcttaaaaacccacgactaaaaaaaatttctcaaacaacctaaataaacgataaataaaaaatcgtaaaccgaaaaaaaccgaacccgaaaaacgccgtcgtcgtcgtcgccgatcgcgttcccccgaaaaaacctaaaaaactcgaaccgcgaacctcgctacccgccaacccgcgaacaaacccgaacgcgcctaacctacctttatataaacccgtctaaacgtaaaaacgcaacccgcctaacgactaaacccgaaacccgcaaccctacgacgtctaccctcctccgacgcgacccctcatcccgacgaacacgacgacgatataaaccataaattaaaaaaaaaacgacgtaaaaaaaaaaaaataacgaccgacaaaaacgacgataacgcaaaaaaaattacttttctaaaaaatacgtctatttctacccttaacgaaaaaaaaaaaaaatatactaaaaaacgtaacccccaaaaccccgaatattcaattatctacgctaaataaatttcgaaaacgataaaatacgaaaaataaacgataacgaaaaaaaaatatactacgaacgcacctaattcgaatccgcctaaacgaaaaactcgactacgaaccgattcgacccaaaaaacgcgaataaattaaactacgaacc

SEQ ID NO: 40615 - DNA, 666 bp, Artificial Sequence
  chemically treated genomic DNA (Homo sapiens) CpG-island No: 40615
tttttttttgggaatttacggttgggggaagttttttaggtagtttgggtgggcggtggatggggagtcgtgggtcgagaggaatcgggttcgggaagcgtcgtcgtcgtcgtcgtcggtcgcgttttttcggagaggtttgagaagttcgggtcgcgggtttcgttgttcgttagttcgcggataggttcgggcgcgtttggtttgtttttgtataggttcgtttgaacgtgggagcgtagttcgtttgacggttgagttcgaggttcgtaattttgcggcgtttattttttttcggcgcggttttttatttcggcgagtacggcggcggtgtgggttatggattaagaaggaggcggcgtgggaggaggaagatggcggtcggtaagagcggcggtagcgtaggggagattatttttttggaaggtacgtttgtttttgtttttgacggggagaagggagggtatattggaaaacgtggtttttagaatttcggatatttagttatttgcgttgggtgggtttcgggggcggtgaagtacgagggatgagcgatgacggggagggagtgtgttgcgagcgtatttggttcgagttcgtttaggcgaggggttcggttgcgagtcggttcggtttagggggcgcgggtggattgagttacgagtt

SEQ ID NO: 40616 - DNA, 666 bp, Artificial Sequence
  chemically treated genomic DNA (Homo sapiens) CpG-island No: 40616
aactcgtaactcaatccacccgcgccccctaaaccgaaccgactcgcaaccgaacccctcgcctaaacgaactcgaaccaaatacgctcgcaacacactccctccccgtcatcgctcatccctcgtacttcaccgcccccgaaacccacccaacgcaaataactaaatatccgaaattctaaaaaccacgttttccaatataccctcccttctccccgtcaaaaacaaaaacaaacgtaccttccaaaaaaataatctcccctacgctaccgccgctcttaccgaccgccatcttcctcctcccacgccgcctccttcttaatccataacccacaccgccgccgtactcgccgaaataaaaaaccgcgccgaaaaaaaataaacgccgcaaaattacgaacctcgaactcaaccgtcaaacgaactacgctcccacgttcaaacgaacctatacaaaaacaaaccaaacgcgcccgaacctatccgcgaactaacgaacaacgaaacccgcgacccgaacttctcaaacctctccgaaaaaacgcgaccgacgacgacgacgacgacgcttcccgaacccgattcctctcgacccacgactccccatccaccgcccacccaaactacctaaaaaacttcccccaaccgtaaattcccaaaaaaaaa

SEQ ID NO: 40617 - DNA, 523 bp, Artificial Sequence
  chemically treated genomic DNA (Homo sapiens) CpG-island No: 40617
ttttaggtcgtaaaatggtcgtattcgtcgcgtcggagcggcgaggtttttgcgatcgttaggcgtttttaggtttttagttcgttttgtagtcgtcgtcgttacggtcgttcgtttatttcgtttaggcgtgaatgtattagcggaggtttttgcgattgtttatgtggataggggtgggttttttttgttatcgtttcgcgtcggtcgttatagtagttttagtcgtcgtcgttgtcgttttttttttacgggcgttggagttgtcgttcggttttcgttttcgtttcgacgtcgtcgtttttagcgcggtttttttttagtagttcggattcggttcgcgggtagagttggttgcggcgtcgtatcgagttttgatttgtgggcgttcgtcgttcgggttttcggtagggtaggttttttacggcgcgggttcggtttagatacgttatatttaaaatttttatcgtttaggggggggtggtagatttggcgtgtgcgatgggtttgtttttttggtatt

SEQ ID NO: 40618 - DNA, 523 bp, Artificial Sequence
  chemically treated genomic DNA (Homo sapiens) CpG-island No: 40618
aataccaaaaaaacaaacccatcgcacacgccaaatctaccacccccccctaaacgataaaaattttaaatataacgtatctaaaccgaacccgcgccgtaaaaaacctaccctaccgaaaacccgaacgacgaacgcccacaaatcaaaactcgatacgacgccgcaaccaactctacccgcgaaccgaatccgaactactaaaaaaaaaccgcgctaaaaacgacgacgtcgaaacgaaaacgaaaaccgaacgacaactccaacgcccgtaaaaaaaaaacgacaacgacgacgactaaaactactataacgaccgacgcgaaacgataacaaaaaaaacccacccctatccacataaacaatcgcaaaaacctccgctaatacattcacgcctaaacgaaataaacgaacgaccgtaacgacgacgactacaaaacgaactaaaaacctaaaaacgcctaacgatcgcaaaaacctcgccgctccgacgcgacgaatacgaccattttacgacctaaaa

SEQ ID NO: 40619 - DNA, 523 bp, Artificial Sequence
  chemically treated genomic DNA (Homo sapiens) CpG-island No: 40619
ggtgttagaggagtaaatttatcgtatacgttaggtttgttatttttttttgggcggtggggattttggatgtaacgtgtttaggtcgagttcgcgtcgtgaaaggtttattttgtcgaaagttcgggcggcgggcgtttataagttagggttcggtgcggcgtcgtagttagttttgttcgcgagtcgagttcgggttgttgagggggagtcgcgttgggggcggcggcgtcggggcgggggcgggagtcgggcggtagttttagcgttcgtgggggaggagcggtagcggcggcggttggagttgttgtggcgatcgacgcgaggcggtggtagaggagatttatttttgtttatatggatagtcgtaaaggttttcgttgatgtatttacgtttgggcggggtgggcggacggtcgtagcggcggcggttgtagaacgagttaggggtttgggggcgtttgacggtcgtagagatttcgtcgtttcggcgcggcgggtgcggttattttacggtttggga

SEQ ID NO: 40620 - DNA, 523 bp, Artificial Sequence
  chemically treated genomic DNA (Homo sapiens) CpG-island No: 40620
tcccaaaccgtaaaataaccgcacccgccgcgccgaaacgacgaaatctctacgaccgtcaaacgcccccaaacccctaactcgttctacaaccgccgccgctacgaccgtccgcccaccccgcccaaacgtaaatacatcaacgaaaacctttacgactatccatataaacaaaaataaatctcctctaccaccgcctcgcgtcgatcgccacaacaactccaaccgccgccgctaccgctcctcccccacgaacgctaaaactaccgcccgactcccgcccccgccccgacgccgccgcccccaacgcgactccccctcaacaacccgaactcgactcgcgaacaaaactaactacgacgccgcaccgaaccctaacttataaacgcccgccgcccgaactttcgacaaaataaacctttcacgacgcgaactcgacctaaacacgttacatccaaaatccccaccgcccaaaaaaaaataacaaacctaacgtatacgataaatttactcctctaacacc

SEQ ID NO: 40621 - DNA, 538 bp, Artificial Sequence
  chemically treated genomic DNA (Homo sapiens) CpG-island No: 40621
gggcggagtttggtaatttggggattattaataggatgtttagtcggaggtggttttgcgcgtgacgtaacggtgttcggaggtagggggcgtaggggtcgggttgttcggcgttttagtttagtagcgacgttgcgggttttgggcgttaggagagtttttcggagtcgatttttttgttggttgttttgtgatcgtttttcggttttgtttttttggtcgaagtgttcgttgtcgggcgcgggttttaggtaacggtggtgttttcgcgttttttttcgtttttcgattgggtttatcggttttagttcgcggggaagggagaagcggtggcggtagtagtttcggtcggtttttgttttgggttgtgttgcgaagaaggtaaggttcggcgattgtaggggagttgggtaggggagggcgggaaagttatcgttaggcgttcgggttacgggtagttttttaaattttgtacgttggtttggtgtttcgtaaatttcgtggtattttttaagttagtagtaaagaaagttagtaa

SEQ ID NO: 40622 - DNA, 538 bp, Artificial Sequence
  chemically treated genomic DNA (Homo sapiens) CpG-island No: 40622
ttactaactttctttactactaacttaaaaaataccacgaaatttacgaaacaccaaaccaacgtacaaaatttaaaaaactacccgtaacccgaacgcctaacgataactttcccgccctcccctacccaactcccctacaatcgccgaaccttaccttcttcgcaacacaacccaaaacaaaaaccgaccgaaactactaccgccaccgcttctcccttccccgcgaactaaaaccgataaacccaatcgaaaaacgaaaaaaaacgcgaaaacaccaccgttacctaaaacccgcgcccgacaacgaacacttcgaccaaaaaaacaaaaccgaaaaacgatcacaaaacaaccaacaaaaaaatcgactccgaaaaactctcctaacgcccaaaacccgcaacgtcgctactaaactaaaacgccgaacaacccgacccctacgccccctacctccgaacaccgttacgtcacgcgcaaaaccacctccgactaaacatcctattaataatccccaaattaccaaactccgccc

SEQ ID NO: 40623 - DNA, 538 bp, Artificial Sequence
  chemically treated genomic DNA (Homo sapiens) CpG-island No: 40623
ttgttaattttttttattattgatttgagagatgttacgagatttgcggaatattaaattagcgtgtagggtttaaaaggttgttcgtgattcgggcgtttgacggtaattttttcgtttttttttatttaatttttttgtagtcgtcgagttttgtttttttcgtagtatagtttaggataagggtcggtcggagttgttgtcgttatcgtttttttttttttcgcgggttgaggtcggtggatttaatcgggaagcgaggagaggcgcgggagtattatcgttatttgaggttcgcgttcggtagcgggtatttcggttaagaggatagagtcggaaagcggttatagagtagttagtaggaaggtcgatttcggaaagtttttttggcgtttagggttcgtaacgtcgttgttaagttaaagcgtcggatagttcggtttttacgttttttgttttcgagtatcgttgcgttacgcgtagggttattttcggttgagtattttattggtggtttttaggttgttaggtttcgttt

SEQ ID NO: 40624 - DNA, 538 bp, Artificial Sequence
  chemically treated genomic DNA (Homo sapiens) CpG-island No: 40624
aaacgaaacctaacaacctaaaaaccaccaataaaatactcaaccgaaaataaccctacgcgtaacgcaacgatactcgaaaacaaaaaacgtaaaaaccgaactatccgacgctttaacttaacaacgacgttacgaaccctaaacgccaaaaaaactttccgaaatcgaccttcctactaactactctataaccgctttccgactctatcctcttaaccgaaatacccgctaccgaacgcgaacctcaaataacgataatactcccgcgcctctcctcgcttcccgattaaatccaccgacctcaacccgcgaaaaaaaaaaaaacgataacgacaacaactccgaccgacccttatcctaaactatactacgaaaaaaacaaaactcgacgactacaaaaaaattaaataaaaaaaaacgaaaaaattaccgtcaaacgcccgaatcacgaacaaccttttaaaccctacacgctaatttaatattccgcaaatctcgtaacatctctcaaatcaataataaaaaaaattaacaa

SEQ ID NO: 40625 - DNA, 1424 bp, Artificial Sequence
  chemically treated genomic DNA (Homo sapiens) CpG-island No: 40625
cggtttcgcgttttcgttttacgtttcggagtcgtttagtcgcggttttttagtttcggtcgcgttttagttttaacggtttcgcgttcgttcgtcgtaggtggtcgtgagggaggtgttatagtttcggttgtttacgatagatacgggcgttttagcgcgcgtacgttcggcgtcgttgcgtcgttttcgttttttcggcgtgcgcgcgttcggcgggtcggcgggggcggggagggggcggagtcgtcggcggcggggttgaggcgttgaggcggtcgtggcggcggcggcggcggcggcggtagcggcggttaagcggttaggttggcggtcggggtttcgggtcgcgcgaggttacggttacgtcgcgtcgttgcgtataattaacgaggtagagcgtcgttcggcgcgagattgcggtcgaagcgtggggcgcgcgtgcggaggattaggcgcggcgcggttgcggttgaggtgagggcggcgcggggtcgcggcggttcgggcgggcgcgggtttcggatttcgcggtggcggcgtttatgtaagcgtcgggtagggattggtggtggggtcggagttgcgggtcgtttcgggagcggagggcgttcgcggagaagcgagggtgtcgcggtatcgtttcgtatttatttttttgggtcgttcgtttgtttcggcgttcggttttcggaggaagttgcgttcgggcggtttcgcgttttttttcgagggcgtcgagttcgcgtgggatgcgtcgcgttgcgtcgcggggagggtaggtgcgtcgggacgaggttgcgttttggggatcgagattgcgttttggggaggggacggtgtgttttggagatcggaggttgcgttggggacgaggttgcgttcggggattagaggttgtttcgggtataaggttgcgtcggggaacgggaggttgcgttggtaataaggttgcgtttggggacggtaggttatgtttttggggagacgtttcgttcggtatgggacgttgcgtcgggggacggtaggttgcgttcgggatgaggttgggttcgggtaggggaggttgttttgggaggggacgttgtgttacgggagtggagattgcgttggggacgagtttgcgttttggacggttttgcgtgttttttcgagggcgtagtgttcgcgcgggatgttttgcgtcgcgggcggttcgggttagggaagtttttgcgggtgtcgggcgtttgtagcgatcgggagtaatttggggtagttgggggttcgaggtgatttttgacgtgtttatattagaaggaaaattattgcgtggtggatgggtgcgagggaaggtgttagattgggttgtggacgttgaaacgtgttggagtttcgatttatacgttggaaaatttaatttaaaacgtgtttttgtttaggtt

SEQ ID NO: 40626 - DNA, 1424 bp, Artificial Sequence
  chemically treated genomic DNA (Homo sapiens) CpG-island No: 40626
aacctaaacaaaaacacgttttaaattaaattttccaacgtataaatcgaaactccaacacgtttcaacgtccacaacccaatctaacaccttccctcgcacccatccaccacgcaataattttccttctaatataaacacgtcaaaaatcacctcgaacccccaactaccccaaattactcccgatcgctacaaacgcccgacacccgcaaaaacttccctaacccgaaccgcccgcgacgcaaaacatcccgcgcgaacactacgccctcgaaaaaacacgcaaaaccgtccaaaacgcaaactcgtccccaacgcaatctccactcccgtaacacaacgtcccctcccaaaacaacctcccctacccgaacccaacctcatcccgaacgcaacctaccgtcccccgacgcaacgtcccataccgaacgaaacgtctccccaaaaacataacctaccgtccccaaacgcaaccttattaccaacgcaacctcccgttccccgacgcaaccttatacccgaaacaacctctaatccccgaacgcaacctcgtccccaacgcaacctccgatctccaaaacacaccgtcccctccccaaaacgcaatctcgatccccaaaacgcaacctcgtcccgacgcacctaccctccccgcgacgcaacgcgacgcatcccacgcgaactcgacgccctcgaaaaaaaacgcgaaaccgcccgaacgcaacttcctccgaaaaccgaacgccgaaacaaacgaacgacccaaaaaaataaatacgaaacgataccgcgacaccctcgcttctccgcgaacgccctccgctcccgaaacgacccgcaactccgaccccaccaccaatccctacccgacgcttacataaacgccgccaccgcgaaatccgaaacccgcgcccgcccgaaccgccgcgaccccgcgccgccctcacctcaaccgcaaccgcgccgcgcctaatcctccgcacgcgcgccccacgcttcgaccgcaatctcgcgccgaacgacgctctacctcgttaattatacgcaacgacgcgacgtaaccgtaacctcgcgcgacccgaaaccccgaccgccaacctaaccgcttaaccgccgctaccgccgccgccgccgccgccgccacgaccgcctcaacgcctcaaccccgccgccgacgactccgccccctccccgcccccgccgacccgccgaacgcgcgcacgccgaaaaaacgaaaacgacgcaacgacgccgaacgtacgcgcgctaaaacgcccgtatctatcgtaaacaaccgaaactataacacctccctcacgaccacctacgacgaacgaacgcgaaaccgttaaaactaaaacgcgaccgaaactaaaaaaccgcgactaaacgactccgaaacgtaaaacgaaaacgcgaaaccg

SEQ ID NO: 40627 - DNA, 1424 bp, Artificial Sequence
  chemically treated genomic DNA (Homo sapiens) CpG-island No: 40627
aatttggataggaatacgttttaggttaggttttttagcgtgtaaatcgggattttaatacgttttagcgtttatagtttaatttgatattttttttcgtatttatttattacgtaataattttttttttgatgtgaatacgttaaaagttatttcgggtttttaattgttttagattgttttcgatcgttgtagacgttcggtattcgtaggaatttttttggttcgggtcgttcgcggcgtagagtatttcgcgcggatattgcgttttcggaaggatacgtaggatcgtttagggcgtagattcgtttttaacgtagtttttattttcgtggtatagcgtttttttttaaggtagttttttttgttcgggtttagttttatttcgggcgtagtttgtcgtttttcggcgtagcgttttatgtcgggcggagcgtttttttagggatatagtttatcgtttttaggcgtagttttgttgttaacgtagtttttcgtttttcggcgtaattttgtattcggggtagtttttggttttcgggcgtagtttcgtttttagcgtagttttcgatttttagggtatatcgttttttttttaaaacgtagtttcggtttttagggcgtagtttcgtttcggcgtatttgtttttttcgcggcgtagcgcggcgtattttacgcggattcggcgttttcgggaggggacgcggggtcgttcgggcgtagtttttttcgggagtcgagcgtcggagtagacgggcgatttaggagggtgggtgcgaggcggtgtcgcggtattttcgttttttcgcgggcgtttttcgttttcgggacggttcgtagtttcggttttattattagtttttgttcggcgtttatataaacgtcgttatcgcggggttcggagttcgcgttcgttcgagtcgtcgcggtttcgcgtcgtttttattttagtcgtagtcgcgtcgcgtttggtttttcgtacgcgcgttttacgtttcggtcgtagtttcgcgtcgggcggcgttttgtttcgttggttgtgcgtagcggcgcggcgtggtcgtggtttcgcgcggttcggagtttcggtcgttaatttggtcgtttggtcgtcgttgtcgtcgtcgtcgtcgtcgtcgttacggtcgttttagcgttttagtttcgtcgtcggcggtttcgtttttttttcgttttcgtcggttcgtcgggcgcgcgtacgtcgagggggcgggggcggcgtagcgacgtcggacgtgcgcgcgttggggcgttcgtgtttgtcgtgggtagtcggagttgtggtattttttttacgattatttgcggcggacgggcgcggggtcgttggggttggagcgcggtcggagttgagagatcgcggttgggcggtttcggagcgtggggcgagagcgcgggatcg

SEQ ID NO: 40628 - DNA, 1424 bp, Artificial Sequence
  chemically treated genomic DNA (Homo sapiens) CpG-island No: 40628
cgatcccgcgctctcgccccacgctccgaaaccgcccaaccgcgatctctcaactccgaccgcgctccaaccccaacgaccccgcgcccgtccgccgcaaataatcgtaaaaaaaataccacaactccgactacccacgacaaacacgaacgccccaacgcgcgcacgtccgacgtcgctacgccgcccccgccccctcgacgtacgcgcgcccgacgaaccgacgaaaacgaaaaaaaaacgaaaccgccgacgacgaaactaaaacgctaaaacgaccgtaacgacgacgacgacgacgacgacaacgacgaccaaacgaccaaattaacgaccgaaactccgaaccgcgcgaaaccacgaccacgccgcgccgctacgcacaaccaacgaaacaaaacgccgcccgacgcgaaactacgaccgaaacgtaaaacgcgcgtacgaaaaaccaaacgcgacgcgactacgactaaaataaaaacgacgcgaaaccgcgacgactcgaacgaacgcgaactccgaaccccgcgataacgacgtttatataaacgccgaacaaaaactaataataaaaccgaaactacgaaccgtcccgaaaacgaaaaacgcccgcgaaaaaacgaaaataccgcgacaccgcctcgcacccaccctcctaaatcgcccgtctactccgacgctcgactcccgaaaaaaactacgcccgaacgaccccgcgtcccctcccgaaaacgccgaatccgcgtaaaatacgccgcgctacgccgcgaaaaaaacaaatacgccgaaacgaaactacgccctaaaaaccgaaactacgttttaaaaaaaaaacgatataccctaaaaatcgaaaactacgctaaaaacgaaactacgcccgaaaaccaaaaactaccccgaatacaaaattacgccgaaaaacgaaaaactacgttaacaacaaaactacgcctaaaaacgataaactatatccctaaaaaaacgctccgcccgacataaaacgctacgccgaaaaacgacaaactacgcccgaaataaaactaaacccgaacaaaaaaaactaccttaaaaaaaaacgctataccacgaaaataaaaactacgttaaaaacgaatctacgccctaaacgatcctacgtatccttccgaaaacgcaatatccgcgcgaaatactctacgccgcgaacgacccgaaccaaaaaaattcctacgaataccgaacgtctacaacgatcgaaaacaatctaaaacaattaaaaacccgaaataacttttaacgtattcacatcaaaaaaaaaattattacgtaataaataaatacgaaaaaaaatatcaaattaaactataaacgctaaaacgtattaaaatcccgatttacacgctaaaaaacctaacctaaaacgtattcctatccaaatt

SEQ ID NO: 40629 - DNA, 915 bp, Artificial Sequence
  chemically treated genomic DNA (Homo sapiens) CpG-island No: 40629
tcgatgggtgtatgttcgatagtggtgtgtgcgtttatcgggtgtgtgttcgacggtgtgtgcgttcgatgggtgtgtgtgttcgatagtggtgtgtgcgttcgatgggtgtgtgtgttcgatagtggtgtgtgcgttcgtcgggtgtgcgttcgacgggggtgtgtgttcgatagtggtgtgtgcgttcgacgggggtgtgtgttcgatagtggtgtgtgcgttcgacgggggtgtgtgttcgatagtggtgtgtgcgttcgacgggggtgtgtgttcgattggtgtgtgcgttcgacgggtgtgtgtgttcgatagtggtgtgtgcgttcgatgggtgtgtgtgttcgatagtggtgtgtgcgttcgtcgggtgtgtgttcgatagtggtgtgtgttcgatagtggtgtgtgcgttcgacgggggtgtgtgttcgatagtggtgtgtgcgttcgttgggtgtgtgtttaatagtggtgtgtgcgttcgatgggtgtgtgtgttcgatagtggtgtgtgcgttcgtcgggtgtgtgttcgatagtggtgtgtgttcgatagtggtgtgtgttcgatagtggtgtgtgtattcgacgggggtatgtgttcgatagtggtgtgtgcgttcgtcgggtgtgtgttcgatagtggtgtgtgcgttcgacgggggtgtgtgttcgatagtggtgtgtgcgttcgacgggggtgtgtgttcgatagtggtgtgtgcgttcgatgggtgtgtgtgttcgatagtggtgtgtgcgttcgacgggtgtgtgcgtttgataggagtgtgtttgatatgggtgtgtgagcgttcggtaggggtacgtatattcggggtgtgtgtgtttgacgtgtgtgtgtgtttgatatgggtgtgtgtatttggtagaggtgtgtgcgtttag

SEQ ID NO: 40630 - DNA, 915 bp, Artificial Sequence
  chemically treated genomic DNA (Homo sapiens) CpG-island No: 40630
ctaaacgcacacacctctaccaaatacacacacccatatcaaacacacacacacgtcaaacacacacaccccgaatatacgtacccctaccgaacgctcacacacccatatcaaacacactcctatcaaacgcacacacccgtcgaacgcacacaccactatcgaacacacacacccatcgaacgcacacaccactatcgaacacacacccccgtcgaacgcacacaccactatcgaacacacacccccgtcgaacgcacacaccactatcgaacacacacccgacgaacgcacacaccactatcgaacacatacccccgtcgaatacacacaccactatcgaacacacaccactatcgaacacacaccactatcgaacacacacccgacgaacgcacacaccactatcgaacacacacacccatcgaacgcacacaccactattaaacacacacccaacgaacgcacacaccactatcgaacacacacccccgtcgaacgcacacaccactatcgaacacacaccactatcgaacacacacccgacgaacgcacacaccactatcgaacacacacacccatcgaacgcacacaccactatcgaacacacacacccgtcgaacgcacacaccaatcgaacacacacccccgtcgaacgcacacaccactatcgaacacacacccccgtcgaacgcacacaccactatcgaacacacacccccgtcgaacgcacacaccactatcgaacacacacccccgtcgaacgcacacccgacgaacgcacacaccactatcgaacacacacacccatcgaacgcacacaccactatcgaacacacacacccatcgaacgcacacaccgtcgaacacacacccgataaacgcacacaccactatcgaacatacacccatcga

SEQ ID NO: 40631 - DNA, 915 bp, Artificial Sequence
  chemically treated genomic DNA (Homo sapiens) CpG-island No: 40631
ttgggcgtatatatttttgttaggtgtatatatttatgttagatatatatatacgttaggtatatatatttcgagtgtacgtatttttgtcgggcgtttatatatttatgttagatatatttttgttaggcgtatatattcgtcgggcgtatatattattgtcgggtatatatatttatcgggcgtatatattattgtcgggtatatattttcgtcgggcgtatatattattgtcgggtatatattttcgtcgggcgtatatattattgtcgggtatatattcggcgggcgtatatattattgtcgggtatatattttcgtcgggtgtatatattattgtcgggtatatattattgtcgggtatatattattgtcgggtatatattcggcgggcgtatatattattgtcgggtatatatatttatcgggcgtatatattattgttgggtatatatttagcgggcgtatatattattgtcgggtatatattttcgtcgggcgtatatattattgtcgggtatatattattgtcgggtatatattcggcgggcgtatatattattgtcgggtatatatatttatcgggcgtatatattattgtcgggtatatatattcgtcgggcgtatatattagtcgggtatatattttcgtcgggcgtatatattattgtcgggtatatattttcgtcgggcgtatatattattgtcgggtatatattttcgtcgggcgtatatattattgtcgggtatatattttcgtcgggcgtatattcggcgggcgtatatattattgtcgggtatatatatttatcgggcgtatatattattgtcgggtatatatatttatcgggcgtatatatcgtcgggtatatattcggtgggcgtatatattattgtcgagtatatatttatcgg

SEQ ID NO: 40632 - DNA, 915 bp, Artificial Sequence
  chemically treated genomic DNA (Homo sapiens) CpG-island No: 40632
ccgataaatatatactcgacaataatatatacgcccaccgaatatatacccgacgatatatacgcccgataaatatatatacccgacaataatatatacgcccgataaatatatatacccgacaataatatatacgcccgccgaatatacgcccgacgaaaatatatacccgacaataatatatacgcccgacgaaaatatatacccgacaataatatatacgcccgacgaaaatatatacccgacaataatatatacgcccgacgaaaatatatacccgactaatatatacgcccgacgaatatatatacccgacaataatatatacgcccgataaatatatatacccgacaataatatatacgcccgccgaatatatacccgacaataatatatacccgacaataatatatacgcccgacgaaaatatatacccgacaataatatatacgcccgctaaatatatacccaacaataatatatacgcccgataaatatatatacccgacaataatatatacgcccgccgaatatatacccgacaataatatatacccgacaataatatatacccgacaataatatatacacccgacgaaaatatatacccgacaataatatatacgcccgccgaatatatacccgacaataatatatacgcccgacgaaaatatatacccgacaataatatatacgcccgacgaaaatatatacccgacaataatatatacgcccgataaatatatatacccgacaataatatatacgcccgacgaatatatacgcctaacaaaaatatatctaacataaatatataaacgcccgacaaaaatacgtacactcgaaatatatatacctaacgtatatatatatctaacataaatatatacacctaacaaaaatatatacgcccaa

SEQ ID NO: 40633 - DNA, 834 bp, Artificial Sequence
  chemically treated genomic DNA (Homo sapiens) CpG-island No: 40633
ttacgttttgtagtgtcgggttttgcggcgattattgagttttttcgttttcgtttttagttttttcgttttcgttttcggttttcgtttttttagtcggtcggggttcgtcgtttacgatttcgtacgtgtcgtcgacgtcgttttgtcgatttcgtcgtaggaggtggaattgtagtggtgtcggcggttttttttttggggcggcggtggcgaggcgttcgttggcggcgggtagcggttggatgaaatacgttttttttagtaggtagaaggcgtcgcgtacgttttcgtagaggttgagggcggtagtcgagttgggatcgttatttacggtgtcggagtagaagtagtgcgttaggtcggttttcggaagcggcgtttcggattcggatttgcgttttacgttttggagcgtgaagtcgggcgttaaaaagttgttgtcgggtcgtagttttagatttagttgttggttaaaggcgtgtaggcggaggcgcgtggtttcgtgtttcggggcgcgttttagtttcggtattattagtttttcgtttttttcggaggggcgttcgagtgcgttcgatacggttagtagcgtcgcggcgagtagtagtagcgtgggtattggtttaaagtttcgagatttcggagttcgtttcgcgttttttatgtcgttgtttagtttgcgtttttcgaatttttcgggtatagttcgttgtattggagttttaggagatatcgttcgtagtagcgtacggagcgagggatttttagttcgggtcgggagagtaaagtttcgttggtttgttttggattgttaaaattaataatttttat

SEQ ID NO: 40634 - DNA, 834 bp, Artificial Sequence
  chemically treated genomic DNA (Homo sapiens) CpG-island No: 40634
ataaaaattattaattttaacaatccaaaacaaaccaacgaaactttactctcccgacccgaactaaaaatccctcgctccgtacgctactacgaacgatatctcctaaaactccaatacaacgaactatacccgaaaaattcgaaaaacgcaaactaaacaacgacataaaaaacgcgaaacgaactccgaaatctcgaaactttaaaccaatacccacgctactactactcgccgcgacgctactaaccgtatcgaacgcactcgaacgcccctccgaaaaaaacgaaaaactaataataccgaaactaaaacgcgccccgaaacacgaaaccacgcgcctccgcctacacgcctttaaccaacaactaaatctaaaactacgacccgacaacaactttttaacgcccgacttcacgctccaaaacgtaaaacgcaaatccgaatccgaaacgccgcttccgaaaaccgacctaacgcactacttctactccgacaccgtaaataacgatcccaactcgactaccgccctcaacctctacgaaaacgtacgcgacgccttctacctactaaaaaaaacgtatttcatccaaccgctacccgccgccaacgaacgcctcgccaccgccgccccaaaaaaaaaaccgccgacaccactacaattccacctcctacgacgaaatcgacaaaacgacgtcgacgacacgtacgaaatcgtaaacgacgaaccccgaccgactaaaaaaacgaaaaccgaaaacgaaaacgaaaaaactaaaaacgaaaacgaaaaaactcaataatcgccgcaaaacccgacactacaaaacgtaa

SEQ ID NO: 40635 - DNA, 834 bp, Artificial Sequence
  chemically treated genomic DNA (Homo sapiens) CpG-island No: 40635
atagaaattgttaattttaataatttagagtaggttaacgaggttttgttttttcgattcgaattaaaggtttttcgtttcgtgcgttgttacgagcggtgttttttggggttttaatgtagcgagttgtgttcgaggggttcggaaggcgtaagttgggtagcgatatggggaacgcggagcgggtttcggggtttcggagttttgggttagtatttacgttgttgttgttcgtcgcggcgttattggtcgtgtcggacgtattcgggcgttttttcgaggaggacgaggagttagtggtgtcggagttggagcgcgtttcgggatacgggattacgcgttttcgtttgtacgtttttgattagtagttggatttggagttgcggttcgatagtagttttttggcgttcggttttacgttttagaacgtggggcgtaaattcgggttcgagacgtcgttttcggaaatcgatttggcgtattgtttttatttcggtatcgtgaatggcgattttagttcggttgtcgtttttagtttttgcgagggcgtgcgcggcgttttttatttgttgggggaggcgtattttatttagtcgttgttcgtcgttagcgagcgtttcgttatcgtcgttttaggggagaagtcgtcggtattattatagttttattttttgcggcggaatcggtagggcgacgtcggcggtacgtgcggggtcgtggacgacgagtttcggtcgattgggaaagcggagatcgaagacgaggacgaagggattgagggcgaggacgaaggggtttagtggtcgtcgtaggattcggtattgtaaggcgtag

SEQ ID NO: 40636 - DNA, 834 bp, Artificial Sequence
  chemically treated genomic DNA (Homo sapiens) CpG-island No: 40636
ctacgccttacaataccgaatcctacgacgaccactaaaccccttcgtcctcgccctcaatcccttcgtcctcgtcttcgatctccgctttcccaatcgaccgaaactcgtcgtccacgaccccgcacgtaccgccgacgtcgccctaccgattccgccgcaaaaaataaaactataataataccgacgacttctcccctaaaacgacgataacgaaacgctcgctaacgacgaacaacgactaaataaaatacgcctcccccaacaaataaaaaacgccgcgcacgccctcgcaaaaactaaaaacgacaaccgaactaaaatcgccattcacgataccgaaataaaaacaatacgccaaatcgatttccgaaaacgacgtctcgaacccgaatttacgccccacgttctaaaacgtaaaaccgaacgccaaaaaactactatcgaaccgcaactccaaatccaactactaatcaaaaacgtacaaacgaaaacgcgtaatcccgtatcccgaaacgcgctccaactccgacaccactaactcctcgtcctcctcgaaaaaacgcccgaatacgtccgacacgaccaataacgccgcgacgaacaacaacaacgtaaatactaacccaaaactccgaaaccccgaaacccgctccgcgttccccatatcgctacccaacttacgccttccgaacccctcgaacacaactcgctacattaaaaccccaaaaaacaccgctcgtaacaacgcacgaaacgaaaaacctttaattcgaatcgaaaaaacaaaacctcgttaacctactctaaattattaaaattaacaatttctat

SEQ ID NO: 40637 - DNA, 541 bp, Artificial Sequence
  chemically treated genomic DNA (Homo sapiens) CpG-island No: 40637
tcggtcgtgcgtaaggggttttaggcgtttagtatttttttagtatttcgggaggcgttttgttcggttggttttagcgttcgattttcgggcgtatttatttgtcgcgtcgcgttttttatattcgtttttattttcgggcggggtagggggtatcggcgggttttaggcgtttaggtttttttttttagttcggatttcgagtcgggattttggtatcggcgtcgtttatttgtcgcgttttaggcggcgtttttcgtttttcgtttttcgttttcgttttcgttttttgtttagttcgcgtttattcggttcggttcgttttggttttcgttttaattttaggaggcggtgttttagggtttagggcgatatttttaagcgggtcgcgggttattttgggcgggcgggggcgggggcggcgggaggaggcgttttttaagggaagttcgggacgggttttttgtttggtttaatttcggttgcggagggatttataagggattttggggcgtttttcgggttcggttatagcggttaa

SEQ ID NO: 40638 - DNA, 541 bp, Artificial Sequence
  chemically treated genomic DNA (Homo sapiens) CpG-island No: 40638
ttaaccgctataaccgaacccgaaaaacgccccaaaatcccttataaatccctccgcaaccgaaattaaaccaaacaaaaaacccgtcccgaacttcccttaaaaaacgcctcctcccgccgcccccgcccccgcccgcccaaaataacccgcgacccgcttaaaaatatcgccctaaaccctaaaacaccgcctcctaaaattaaaacgaaaaccaaaacgaaccgaaccgaataaacgcgaactaaacaaaaaacgaaaacgaaaacgaaaaacgaaaaacgaaaaacgccgcctaaaacgcgacaaataaacgacgccgataccaaaatcccgactcgaaatccgaactaaaaaaaaaaacctaaacgcctaaaacccgccgataccccctaccccgcccgaaaataaaaacgaatataaaaaacgcgacgcgacaaataaatacgcccgaaaatcgaacgctaaaaccaaccgaacaaaacgcctcccgaaatactaaaaaaatactaaacgcctaaaaccccttacgcacgaccga

SEQ ID NO: 40639 - DNA, 541 bp, Artificial Sequence
  chemically treated genomic DNA (Homo sapiens) CpG-island No: 40639
ttggtcgttgtggtcgggttcgggaagcgttttagagttttttatgggttttttcgtagtcggggttgagttaggtagggaattcgtttcggattttttttgggaaacgttttttttcgtcgttttcgttttcgttcgtttagggtgattcgcgattcgtttgggggtgtcgttttggattttgggatatcgttttttgagattaaagcgagagttagggcgggtcgggtcgagtaggcgcgagttaagtaggaggcggaggcggaggcggagggcgaggggcggggagcgtcgtttggagcgcggtaggtgagcggcgtcggtattagggtttcggttcggggttcgggttggggaggggaatttgggcgtttgggattcgtcgatgttttttgtttcgttcggaggtgaaagcgggtgtgaggagcgcggcgcggtaggtgagtgcgttcgagggtcgagcgttggggttagtcgggtagggcgtttttcggggtgttgggagagtgttgggcgtttgggattttttgcgtacggtcga

SEQ ID NO: 40640 - DNA, 541 bp, Artificial Sequence
  chemically treated genomic DNA (Homo sapiens) CpG-island No: 40640
tcgaccgtacgcaaaaaatcccaaacgcccaacactctcccaacaccccgaaaaacgccctacccgactaaccccaacgctcgaccctcgaacgcactcacctaccgcgccgcgctcctcacacccgctttcacctccgaacgaaacaaaaaacatcgacgaatcccaaacgcccaaattcccctccccaacccgaaccccgaaccgaaaccctaataccgacgccgctcacctaccgcgctccaaacgacgctccccgcccctcgccctccgcctccgcctccgcctcctacttaactcgcgcctactcgacccgacccgccctaactctcgctttaatctcaaaaaacgatatcccaaaatccaaaacgacacccccaaacgaatcgcgaatcaccctaaacgaacgaaaacgaaaacgacgaaaaaaaacgtttcccaaaaaaaatccgaaacgaattccctacctaactcaaccccgactacgaaaaaacccataaaaaactctaaaacgcttcccgaacccgaccacaacgaccaa

SEQ ID NO: 40641 - DNA, 920 bp, Artificial Sequence
  chemically treated genomic DNA (Homo sapiens) CpG-island No: 40641
gggataacgatattttttggggtttcggcgacgacgtcgttcggcggcgggggtcgcggggtcgcgggtcggggcggcgaagattttgcgtcgcgtttacgggcgagcgcggttcggtagtttcgcggtttcgcgttgggtttggtcgcgggcgggcggggggcgcgaggtaggggacgggggcgcggagttcggttaggagcgttcgcggcggcgggattcggcgggcgggcggcgcgtagggcgatttcggagcggtttcgggaaatttagtcgggttttgatttcgatcgttaacggtgttcgtagtcggcgaatgtaataaagaatagtcggtatggcggttggatcggggcggcgcgcggttgtcgggcgcggggggcggggggtagcgggtttagggcgcgtcggggttcgcgggggtagcgggtgcggttcggggtcggcggggcgtacgtcggggcgggcggcgggcgtagggttcggagttttatttgtttttggaatgtgtagagcgggatcggattcggatttcgggttgcgattcgtttcggaaattgcgtagtatcggaagtcggggggcggcggcggggtatggcgggatttgtagttcgcgggcgggcgcggggggcgtaggcgagattttggcgcggtcgggggttttgcgggtgggattgcggggcgcgggcggcgtggacggggtagcgggcgcgcgcggggcgggtttggtcggagggaatttcgcgcgcggttttttttttacgtggtacggttttgtcgtttacgcgcgcgggtagttttttttttattttttttcggacgcgttttttgcggagttggggagtggtggcggtgggtgggtcgagtttttttttagaataggtttgggatttgtttttatttacggtgatttttggatt

SEQ ID NO: 40642 - DNA, 920 bp, Artificial Sequence
  chemically treated genomic DNA (Homo sapiens) CpG-island No: 40642
aatccaaaaatcaccgtaaataaaaacaaatcccaaacctattctaaaaaaaaactcgacccacccaccgccaccactccccaactccgcaaaaaacgcgtccgaaaaaaaataaaaaaaaaactacccgcgcgcgtaaacgacaaaaccgtaccacgtaaaaaaaaaaccgcgcgcgaaattccctccgaccaaacccgccccgcgcgcgcccgctaccccgtccacgccgcccgcgccccgcaatcccacccgcaaaacccccgaccgcgccaaaatctcgcctacgccccccgcgcccgcccgcgaactacaaatcccgccataccccgccgccgccccccgacttccgatactacgcaatttccgaaacgaatcgcaacccgaaatccgaatccgatcccgctctacacattccaaaaacaaataaaactccgaaccctacgcccgccgcccgccccgacgtacgccccgccgaccccgaaccgcacccgctacccccgcgaaccccgacgcgccctaaacccgctaccccccgccccccgcgcccgacaaccgcgcgccgccccgatccaaccgccataccgactattctttattacattcgccgactacgaacaccgttaacgatcgaaatcaaaacccgactaaatttcccgaaaccgctccgaaatcgccctacgcgccgcccgcccgccgaatcccgccgccgcgaacgctcctaaccgaactccgcgcccccgtcccctacctcgcgccccccgcccgcccgcgaccaaacccaacgcgaaaccgcgaaactaccgaaccgcgctcgcccgtaaacgcgacgcaaaatcttcgccgccccgacccgcgaccccgcgacccccgccgccgaacgacgtcgtcgccgaaaccccaaaaaatatcgttatccc

SEQ ID NO: 40643 - DNA, 920 bp, Artificial Sequence
  chemically treated genomic DNA (Homo sapiens) CpG-island No: 40643
aatttagaggttatcgtgagtgggggtaagttttaggtttgttttagagaaaaattcgatttatttatcgttattattttttaatttcgtaagaaacgcgttcgaggagaggtggagagggagttgttcgcgcgcgtgggcggtagggtcgtgttacgtgggaggggggtcgcgcgcggaatttttttcggttagattcgtttcgcgcgcgttcgttgtttcgtttacgtcgttcgcgtttcgtagttttattcgtaggattttcggtcgcgttagggtttcgtttgcgtttttcgcgttcgttcgcggattataagtttcgttatgtttcgtcgtcgtttttcggttttcggtgttgcgtagttttcggagcggatcgtaattcggagttcggattcgatttcgttttgtatattttaaaggtaggtaaagtttcgggttttgcgttcgtcgttcgtttcggcgtgcgtttcgtcggtttcgggtcgtattcgttgttttcgcgagtttcggcgcgttttgggttcgttgtttttcgtttttcgcgttcggtagtcgcgcgtcgtttcggtttagtcgttatgtcgattgttttttgttatattcgtcggttgcgggtatcgttggcgatcggagttaaaattcggttggatttttcggagtcgtttcgggatcgttttgcgcgtcgttcgttcgtcgggtttcgtcgtcgcgggcgtttttggtcgggtttcgcgttttcgttttttgtttcgcgtttttcgttcgttcgcggttaggtttagcgcggggtcgcggggttgtcgggtcgcgttcgttcgtgggcgcggcgtagggttttcgtcgtttcggttcgcggtttcgcggttttcgtcgtcgggcggcgtcgtcgtcgaggttttaggggatgtcgttatttt

SEQ ID NO: 40644 - DNA, 920 bp, Artificial Sequence
  chemically treated genomic DNA (Homo sapiens) CpG-island No: 40644
aaaataacgacatcccctaaaacctcgacgacgacgccgcccgacgacgaaaaccgcgaaaccgcgaaccgaaacgacgaaaaccctacgccgcgcccacgaacgaacgcgacccgacaaccccgcgaccccgcgctaaacctaaccgcgaacgaacgaaaaacgcgaaacaaaaaacgaaaacgcgaaacccgaccaaaaacgcccgcgacgacgaaacccgacgaacgaacgacgcgcaaaacgatcccgaaacgactccgaaaaatccaaccgaattttaactccgatcgccaacgatacccgcaaccgacgaatataacaaaaaacaatcgacataacgactaaaccgaaacgacgcgcgactaccgaacgcgaaaaacgaaaaacaacgaacccaaaacgcgccgaaactcgcgaaaacaacgaatacgacccgaaaccgacgaaacgcacgccgaaacgaacgacgaacgcaaaacccgaaactttacctacctttaaaatatacaaaacgaaatcgaatccgaactccgaattacgatccgctccgaaaactacgcaacaccgaaaaccgaaaaacgacgacgaaacataacgaaacttataatccgcgaacgaacgcgaaaaacgcaaacgaaaccctaacgcgaccgaaaatcctacgaataaaactacgaaacgcgaacgacgtaaacgaaacaacgaacgcgcgcgaaacgaatctaaccgaaaaaaattccgcgcgcgacccccctcccacgtaacacgaccctaccgcccacgcgcgcgaacaactccctctccacctctcctcgaacgcgtttcttacgaaattaaaaaataataacgataaataaatcgaatttttctctaaaacaaacctaaaacttacccccactcacgataacctctaaatt

SEQ ID NO: 40645 - DNA, 967 bp, Artificial Sequence
  chemically treated genomic DNA (Homo sapiens) CpG-island No: 40645
cgcgtcggatttcgggcgcggtttttttttaggttttatcgttcgtcgttggggttggggtcgcgttttggttagcgtttattgcgttaggtataggtttatcgtggttagggtcgcgacgaagagcgatattagcgcgagttattgcgttttttcgagttacgagtttagtcgggttatggttatggcgtattttcggttcgtttcgttttaattttttcggtagtttcgggtcggaacggcggatttaggatacgcgttggttgcggttatagcgcgttgggggcgtggagggggcgcggcggggtcggagttcggcgaggagcgtggtcgggggtttttgggcgggtaagcggggaggaaacgcgcggcggtcgcggttcgggttgggcgtaagtttcgtatatttgcggaataggggcgcgagcggatttcgcggttcgcgttttcgattcggcgtttgggaagtttttgggtcgttgcgggtcgcgtttttttttgcgcgcgtcgtttcgggcgtttcgttcgcggtttagcggtggtcggaggaggttttggtcgcggggcggggcggggcgggggcggtgttcgagggagggggcgcggtcgggtttgcgggggtcgtagtttttttttttgtttttaacgcggcgtgttttcgtttttttaaaggttcggttttttcggtttcgttacgtgcgcgcgtcgttcgttttttcggcgtttgttcgcgggtcgcgaggtgattcgggttttcggatttattagtttaatttcggcggttgttgtgcggttgtttggtttggttcgtgtgcgcgtttgtataagtgcgtgtgtgtgtatatgtgtgagtgtgcgtgtgtatagcgcgtagttagggtgatttcgaggattgttatttgttcgttagcgagataggatttaggtttagttttcggaaagtttttggaaattcgtggttgttttt

SEQ ID NO: 40646 - DNA, 967 bp, Artificial Sequence
  chemically treated genomic DNA (Homo sapiens) CpG-island No: 40646
aaaaacaaccacgaatttccaaaaactttccgaaaactaaacctaaatcctatctcgctaacgaacaaataacaatcctcgaaatcaccctaactacgcgctatacacacgcacactcacacatatacacacacacgcacttatacaaacgcgcacacgaaccaaaccaaacaaccgcacaacaaccgccgaaattaaactaataaatccgaaaacccgaatcacctcgcgacccgcgaacaaacgccgaaaaaacgaacgacgcgcgcacgtaacgaaaccgaaaaaaccgaacctttaaaaaaacgaaaacacgccgcgttaaaaacaaaaaaaaaaactacgacccccgcaaacccgaccgcgccccctccctcgaacaccgcccccgccccgccccgccccgcgaccaaaacctcctccgaccaccgctaaaccgcgaacgaaacgcccgaaacgacgcgcgcaaaaaaaaacgcgacccgcaacgacccaaaaacttcccaaacgccgaatcgaaaacgcgaaccgcgaaatccgctcgcgcccctattccgcaaatatacgaaacttacgcccaacccgaaccgcgaccgccgcgcgtttcctccccgcttacccgcccaaaaacccccgaccacgctcctcgccgaactccgaccccgccgcgccccctccacgcccccaacgcgctataaccgcaaccaacgcgtatcctaaatccgccgttccgacccgaaactaccgaaaaaattaaaacgaaacgaaccgaaaatacgccataaccataacccgactaaactcgtaactcgaaaaaacgcaataactcgcgctaatatcgctcttcgtcgcgaccctaaccacgataaacctatacctaacgcaataaacgctaaccaaaacgcgaccccaaccccaacgacgaacgataaaacctaaaaaaaaaccgcgcccgaaatccgacgcg

SEQ ID NO: 40647 - DNA, 967 bp, Artificial Sequence
  chemically treated genomic DNA (Homo sapiens) CpG-island No: 40647
aggggtagttacggatttttagggatttttcgaggattgagtttggattttgtttcgttggcgagtaaatggtagttttcgaaattattttgattgcgcgttgtgtatacgtatatttatatatgtgtatatatacgtatttgtgtaagcgcgtatacgagttaagttaagtagtcgtatagtagtcgtcggggttgggttgatgaattcggaggttcgggttatttcgcggttcgcgggtaggcgtcggaggggcgggcgacgcgcgtacgtggcggggtcgggaaggtcgggtttttaggggggcgggggtacgtcgcgttgggagtaggggggaggattgcggttttcgtaggttcggtcgcgttttttttttcgggtatcgttttcgtttcgtttcgtttcgcggttagagtttttttcggttatcgttgggtcgcgggcgggacgttcggggcggcgcgcgtaggaggaagcgcggttcgtagcggtttaggaattttttagacgtcgagtcgggagcgcgggtcgcggggttcgttcgcgtttttgtttcgtaggtgtgcggggtttgcgtttagttcgggtcgcggtcgtcgcgcgtttttttttcgtttgttcgtttagaggttttcggttacgtttttcgtcgggtttcgatttcgtcgcgttttttttacgtttttagcgcgttgtggtcgtagttagcgcgtgttttgagttcgtcgtttcggttcggggttgtcggggaagttggggcgaggcgggtcggggatgcgttatggttatggttcggttgggttcgtggttcggggaggcgtagtggttcgcgttggtgtcgtttttcgtcgcggttttggttacggtaggtttgtatttggcgtagtgggcgttggttagggcgcgattttagttttagcggcgggcggtggagtttggagaggggtcgcgttcggggttcgacgcg

SEQ ID NO: 40648 - DNA, 967 bp, Artificial Sequence
  chemically treated genomic DNA (Homo sapiens) CpG-island No: 40648
cgcgtcgaaccccgaacgcgacccctctccaaactccaccgcccgccgctaaaactaaaatcgcgccctaaccaacgcccactacgccaaatacaaacctaccgtaaccaaaaccgcgacgaaaaacgacaccaacgcgaaccactacgcctccccgaaccacgaacccaaccgaaccataaccataacgcatccccgacccgcctcgccccaacttccccgacaaccccgaaccgaaacgacgaactcaaaacacgcgctaactacgaccacaacgcgctaaaaacgtaaaaaaaacgcgacgaaatcgaaacccgacgaaaaacgtaaccgaaaacctctaaacgaacaaacgaaaaaaaaacgcgcgacgaccgcgacccgaactaaacgcaaaccccgcacacctacgaaacaaaaacgcgaacgaaccccgcgacccgcgctcccgactcgacgtctaaaaaattcctaaaccgctacgaaccgcgcttcctcctacgcgcgccgccccgaacgtcccgcccgcgacccaacgataaccgaaaaaaactctaaccgcgaaacgaaacgaaacgaaaacgatacccgaaaaaaaaaacgcgaccgaacctacgaaaaccgcaatcctcccccctactcccaacgcgacgtacccccgcccccctaaaaacccgaccttcccgaccccgccacgtacgcgcgtcgcccgcccctccgacgcctacccgcgaaccgcgaaataacccgaacctccgaattcatcaacccaaccccgacgactactatacgactacttaacttaactcgtatacgcgcttacacaaatacgtatatatacacatatataaatatacgtatacacaacgcgcaatcaaaataatttcgaaaactaccatttactcgccaacgaaacaaaatccaaactcaatcctcgaaaaatccctaaaaatccgtaactacccct

SEQ ID NO: 40649 - DNA, 2143 bp, Artificial Sequence
  chemically treated genomic DNA (Homo sapiens) CpG-island No: 40649
gttcggtgttagggttgtgagcgtttgtacgaaaggaaaaattttaggtcgtgtgaagtttaatttttttcgttttttcggttaggtaattttatcggggtatttgtttaaaaatatttcgttttcgaacgcgcgtttttgcggaattttttcgaatcgtagagttttcgtggttgggatcgtatagtaatcgggggtagagtgcgagtttttagcggtgtgttgggatggaaaagtaggagtcgttgaggatggattacggggcgtgttttcgaaaagtcgggaagagatgtggcggggttgtcgcgggcgtttttaaggtcggtacgggtggcgttttgattttttgtttttttagtcgcggatttcggacggggggaagggggtttttttaagcggggagacggtcgtcggtcgagtagtagggtttttggtcggcggagggtgttatgttttgcgggatcgtcgggaagttttagataaggtttgcgggggttttggaggaaaaaaaacgcgttgtgaggtttaggcgttcgcgggaggggtcgggggcggggagggagcgtttagcgggtatcgagcggttacgtttcggttatcgggtcgaggacggggcggcggggttaggtttcggatcgtgaagggagcggcgggtcgcggtaggtgcggggtttttaaggtcgtcggttagttttcgcgtatatttcgcggttcgggtcgtcggtttttaatttttgttcggaataggagaacgcgtttttttttacgaggcgttttaatcgtttcgcgcgaggggcgcgcgtttgggttaggcgtgttttttattttaggggtagttcggttagggtgaagagtgaagttcgtgagggaatggagtatgcgtattcgcgagggcgaggttaagtgttggtagggagcgtgcgtagtgtgaaggtataatcggttacgtgggaattcgggatatgttcggtgagcgtttaggtttcgcgtacgcgtagaagcgttcggagttcgtaattcgttggtggagaaaaaagaggagagaaattattttagagttacgttaggaaaggtcgcgttttgcggggaggttgtagttttttaaggagtttcgtagtttttttagagttaggggcgtgatagttatttatcggtttttagtttcgaggtagacgtcgggttttttttcgtttatattcggttcgcgcgcgtcgtagtcgtcgttgtcgttgtgattttatttattttgaatttgacgttattttatattagggatgaggttatcgtaggtatcgttcgttacgtgcgcggtattttgattgggcgtcgggcgtcggagggcggggcggggggggggtttcgcggcgtagggggacgggggagggcgggtttgttcggagtcgcgcgtcgaacggacgttgtcgcgttgtaagttcgcgttttcggtttatgaggggagtttgcggcggtcgttaggggaggcggtcgggttgggggttacggcgaggaggttgagcgtttcggtcgggtggagttcgtcgcggcgaggagcgcgtcgatttttaggggattttgtcgtttgtcggaggcgtttttgttgcggggtcgtttcgggttattcggtcgcggttttgtttagttgggtcgttagtagttttcgttttcggcgcggcgggatgcgtggcgcgagcgtttagtttttcggaggggaggacgcgttttcgtttatcggtggacggcgggcgatttttcgagtcgacgatttcgatagcgacgggagcgacgcgcggttttttgacgggcgcgggcggcgagcggggttttgcggttttcgggtcggcggtagacgttttcggttcgcgaggaaagttcgcgggaggcggtttttgtcgttcgttagtcgtttagagcgtttttatttttttttttcgacgtaatttggttatttggtttttgggcggggattcggcggtcgcggttagggcgttcgggttcgttcgtcgcgtagatgggggtcggttttgattttcgtcggggcgtttatagcggttcgtaggtagtcggagatttcgtatagtgttcggtttatcggagggttgtgattttttttttttttgtagaaatattataattttattgatga

SEQ ID NO: 40650 - DNA, 2143 bp, Artificial Sequence
  chemically treated genomic DNA (Homo sapiens) CpG-island No: 40650
tcatcaataaaattataatatttctacaaaaaaaaaaaaaatcacaaccctccgataaaccgaacactatacgaaatctccgactacctacgaaccgctataaacgccccgacgaaaatcaaaaccgacccccatctacgcgacgaacgaacccgaacgccctaaccgcgaccgccgaatccccgcccaaaaaccaaataaccaaattacgtcgaaaaaaaaaaataaaaacgctctaaacgactaacgaacgacaaaaaccgcctcccgcgaactttcctcgcgaaccgaaaacgtctaccgccgacccgaaaaccgcaaaaccccgctcgccgcccgcgcccgtcaaaaaaccgcgcgtcgctcccgtcgctatcgaaatcgtcgactcgaaaaatcgcccgccgtccaccgataaacgaaaacgcgtcctcccctccgaaaaactaaacgctcgcgccacgcatcccgccgcgccgaaaacgaaaactactaacgacccaactaaacaaaaccgcgaccgaataacccgaaacgaccccgcaacaaaaacgcctccgacaaacgacaaaatcccctaaaaatcgacgcgctcctcgccgcgacgaactccacccgaccgaaacgctcaacctcctcgccgtaacccccaacccgaccgcctcccctaacgaccgccgcaaactcccctcataaaccgaaaacgcgaacttacaacgcgacaacgtccgttcgacgcgcgactccgaacaaacccgccctcccccgtccccctacgccgcgaaaccccccccccgccccgccctccgacgcccgacgcccaatcaaaataccgcgcacgtaacgaacgatacctacgataacctcatccctaatataaaataacgtcaaattcaaaataaataaaatcacaacgacaacgacgactacgacgcgcgcgaaccgaatataaacgaaaaaaaacccgacgtctacctcgaaactaaaaaccgataaataactatcacgcccctaactctaaaaaaactacgaaactccttaaaaaactacaacctccccgcaaaacgcgacctttcctaacgtaactctaaaataatttctctcctcttttttctccaccaacgaattacgaactccgaacgcttctacgcgtacgcgaaacctaaacgctcaccgaacatatcccgaattcccacgtaaccgattataccttcacactacgcacgctccctaccaacacttaacctcgccctcgcgaatacgcatactccattccctcacgaacttcactcttcaccctaaccgaactacccctaaaataaaaaacacgcctaacccaaacgcgcgcccctcgcgcgaaacgattaaaacgcctcgtaaaaaaaaacgcgttctcctattccgaacaaaaattaaaaaccgacgacccgaaccgcgaaatatacgcgaaaactaaccgacgaccttaaaaaccccgcacctaccgcgacccgccgctcccttcacgatccgaaacctaaccccgccgccccgtcctcgacccgataaccgaaacgtaaccgctcgatacccgctaaacgctccctccccgcccccgacccctcccgcgaacgcctaaacctcacaacgcgttttttttcctccaaaacccccgcaaaccttatctaaaacttcccgacgatcccgcaaaacataacaccctccgccgaccaaaaaccctactactcgaccgacgaccgtctccccgcttaaaaaaacccccttccccccgtccgaaatccgcgactaaaaaaacaaaaaatcaaaacgccacccgtaccgaccttaaaaacgcccgcgacaaccccgccacatctcttcccgacttttcgaaaacacgccccgtaatccatcctcaacgactcctacttttccatcccaacacaccgctaaaaactcgcactctacccccgattactatacgatcccaaccacgaaaactctacgattcgaaaaaattccgcaaaaacgcgcgttcgaaaacgaaatatttttaaacaaataccccgataaaattacctaaccgaaaaaacgaaaaaaattaaacttcacacgacctaaaatttttcctttcgtacaaacgctcacaaccctaacaccgaac

SEQ ID NO: 40651 - DNA, 2143 bp, Artificial Sequence
  chemically treated genomic DNA (Homo sapiens) CpG-island No: 40651
ttattagtggagttgtaatatttttgtaaaaaaaaaaaagattatagtttttcgatgagtcgggtattatgcgaagttttcggttgtttgcgggtcgttgtggacgtttcggcgggggttaggatcgatttttatttgcgcggcgaacgagttcggacgttttggtcgcggtcgtcgggttttcgtttaggggttaggtggttaggttgcgtcgggaggaggaaatggaagcgttttgagcgattagcgagcggtaggagtcgtttttcgcgggtttttttcgcgggtcgggagcgtttgtcgtcgattcgaggatcgtagggtttcgttcgtcgttcgcgttcgttagaaagtcgcgcgtcgttttcgtcgttgtcggggtcgtcggttcggggagtcgttcgtcgtttatcggtgaacgggagcgcgttttttttttcgagggattaagcgttcgcgttacgtatttcgtcgcgtcggaagcggggattattggcggtttagttgggtaggatcgcggtcgaatgattcggggcgatttcgtagtaagggcgttttcggtaggcggtaaagttttttgagaatcggcgcgtttttcgtcgcgacggattttattcggtcggggcgtttagttttttcgtcgtggtttttagttcggtcgttttttttaacggtcgtcgtaggttttttttatggatcgagagcgcgggtttgtagcgcggtagcgttcgttcggcgcgcggtttcgggtaggttcgttttttttcgtttttttgcgtcgcgaggtttttttttcgtttcgtttttcggcgttcggcgtttaattagagtgtcgcgtacgtgacgagcgatgtttgcgatgattttatttttggtgtgggatgacgttaaatttaagatggatggaattatagcggtagcggcggttgcggcgcgcgcgagtcgagtgtgagcggaaaggggttcggcgtttgtttcgagattgaagatcggtgagtaattgttacgtttttagttttaggagaattgcggggttttttgggaggttatagttttttcgtaaaacgcggttttttttgacgtaattttgaggtgatttttttttttttttttttttattagcgggttgcgggtttcgagcgtttttgcgcgtgcgcgggatttgggcgtttatcgagtatgtttcgggtttttacgtagtcgattgtatttttatattgcgtacgttttttgttagtatttggtttcgttttcgcgaatgcgtatgttttatttttttacgggttttattttttattttggtcgagttgtttttggggtaggggatacgtttggtttaggcgcgcgtttttcgcgcggagcggttgaaacgtttcgtggagaagggcgcgtttttttgtttcgggtaggggttgggggtcggcggttcgggtcgcggggtgtgcgcggaagttggtcggcggttttggggatttcgtatttgtcgcgattcgtcgttttttttacggttcgggatttagtttcgtcgtttcgttttcggttcggtggtcggagcgtgatcgttcggtgttcgttggacgtttttttttcgttttcggtttttttcgcggacgtttggattttatagcgcgtttttttttttttagagttttcgtagattttgtttgggatttttcggcggtttcgtagagtatagtatttttcgtcggttaggagttttgttgttcggtcggcgatcgttttttcgtttggaggagttttttttttttcgttcgaggttcgcggttggaggggtagggagttaagacgttattcgtgtcggttttagagacgttcgcggtagtttcgttatattttttttcggtttttcgggaatacgtttcgtagtttatttttagcggtttttgtttttttattttagtatatcgttgggggttcgtattttgttttcggttgttatgcggttttagttacgagggttttgcggttcgggagaatttcgtaagagcgcgcgttcggaggcggggtgtttttagataggtgtttcggtgggattgtttgatcgagaggacggggaaagttagattttatacggtttggggttttttttttcgtgtaagcgtttatagttttggtatcgagt

SEQ ID NO: 40652 - DNA, 2143 bp, Artificial Sequence
  chemically treated genomic DNA (Homo sapiens) CpG-island No: 40652
actcgataccaaaactataaacgcttacacgaaaaaaaaaaccccaaaccgtataaaatctaactttccccgtcctctcgatcaaacaatcccaccgaaacacctatctaaaaacaccccgcctccgaacgcgcgctcttacgaaattctcccgaaccgcaaaaccctcgtaactaaaaccgcataacaaccgaaaacaaaatacgaacccccaacgatatactaaaataaaaaaacaaaaaccgctaaaaataaactacgaaacgtattcccgaaaaaccgaaaaaaaatataacgaaactaccgcgaacgtctctaaaaccgacacgaataacgtcttaactccctacccctccaaccgcgaacctcgaacgaaaaaaaaaaaactcctccaaacgaaaaaacgatcgccgaccgaacaacaaaactcctaaccgacgaaaaatactatactctacgaaaccgccgaaaaatcccaaacaaaatctacgaaaactctaaaaaaaaaaaaacgcgctataaaatccaaacgtccgcgaaaaaaaccgaaaacgaaaaaaaaacgtccaacgaacaccgaacgatcacgctccgaccaccgaaccgaaaacgaaacgacgaaactaaatcccgaaccgtaaaaaaaacgacgaatcgcgacaaatacgaaatccccaaaaccgccgaccaacttccgcgcacaccccgcgacccgaaccgccgacccccaacccctacccgaaacaaaaaaacgcgcccttctccacgaaacgtttcaaccgctccgcgcgaaaaacgcgcgcctaaaccaaacgtatcccctaccccaaaaacaactcgaccaaaataaaaaataaaacccgtaaaaaaataaaacatacgcattcgcgaaaacgaaaccaaatactaacaaaaaacgtacgcaatataaaaatacaatcgactacgtaaaaacccgaaacatactcgataaacgcccaaatcccgcgcacgcgcaaaaacgctcgaaacccgcaacccgctaataaaaaaaaaaaaaaaaaaaaatcacctcaaaattacgtcaaaaaaaaccgcgttttacgaaaaaactataacctcccaaaaaaccccgcaattctcctaaaactaaaaacgtaacaattactcaccgatcttcaatctcgaaacaaacgccgaacccctttccgctcacactcgactcgcgcgcgccgcaaccgccgctaccgctataattccatccatcttaaatttaacgtcatcccacaccaaaaataaaatcatcgcaaacatcgctcgtcacgtacgcgacactctaattaaacgccgaacgccgaaaaacgaaacgaaaaaaaaacctcgcgacgcaaaaaaacgaaaaaaaacgaacctacccgaaaccgcgcgccgaacgaacgctaccgcgctacaaacccgcgctctcgatccataaaaaaaacctacgacgaccgttaaaaaaaacgaccgaactaaaaaccacgacgaaaaaactaaacgccccgaccgaataaaatccgtcgcgacgaaaaacgcgccgattctcaaaaaactttaccgcctaccgaaaacgcccttactacgaaatcgccccgaatcattcgaccgcgatcctacccaactaaaccgccaataatccccgcttccgacgcgacgaaatacgtaacgcgaacgcttaatccctcgaaaaaaaaaacgcgctcccgttcaccgataaacgacgaacgactccccgaaccgacgaccccgacaacgacgaaaacgacgcgcgactttctaacgaacgcgaacgacgaacgaaaccctacgatcctcgaatcgacgacaaacgctcccgacccgcgaaaaaaacccgcgaaaaacgactcctaccgctcgctaatcgctcaaaacgcttccatttcctcctcccgacgcaacctaaccacctaacccctaaacgaaaacccgacgaccgcgaccaaaacgtccgaactcgttcgccgcgcaaataaaaatcgatcctaacccccgccgaaacgtccacaacgacccgcaaacaaccgaaaacttcgcataatacccgactcatcgaaaaactataatcttttttttttttacaaaaatattacaactccactaataa

SEQ ID NO: 40653 - DNA, 774 bp, Artificial Sequence
  chemically treated genomic DNA (Homo sapiens) CpG-island No: 40653
cgcgttagcgaaagttcgtgcgttttcggagtcggggaaggcgcgggttatgattcgggttcgttcgtaaaggtcgggtagtgtcgtaaggcgtgggggcgttttcgttcggtggtttcggggttggtgcgattttgggtacgtcggggtcggggtcggagtcgggggtcgcggcggtcggggagggggaggagtcgcgcggtttcgtcggcgtttcgcgggttagggaaagtgaaagggcggcggggtttttcgcgcgtcgttttaggaagtcgcgagtaggaagcgttcgcggcggtcgggtcgggttgggttgcggagcgcgggtttcggcggcgtaggtgaggcgcggggtcggggtcggatcgggaggcggggatttttcgttttttcgttcgtatttgcggggtagtcggcgtttaggcgtcgtagtcgtttagtatttgcggcgtttttagggagtcgggcgcggggttttgcgtattcggagttcggttttttttttttttttttttttttttcggggggaggtgggggttggtttggatgtttttcgagagtcggggacggttttaagttattttcgcggagggaagtttttgaaatacgatatttagaagagtggttttcggcgataatgtcgggcgttttcggatcggggtaacgttgggatttcggggaagtggaggtagagggagcgggtacggggtcggtagtcgttttacggagttttcggtaggggcgagtttagttgtttagtcgggttttttgttt

SEQ ID NO: 40654 - DNA, 774 bp, Artificial Sequence
  chemically treated genomic DNA (Homo sapiens) CpG-island No: 40654
aaacaaaaaacccgactaaacaactaaactcgcccctaccgaaaactccgtaaaacgactaccgaccccgtacccgctccctctacctccacttccccgaaatcccaacgttaccccgatccgaaaacgcccgacattatcgccgaaaaccactcttctaaatatcgtatttcaaaaacttccctccgcgaaaataacttaaaaccgtccccgactctcgaaaaacatccaaaccaacccccacctccccccgaaaaaaaaaaaaaaaaaaaaaaaaaaccgaactccgaatacgcaaaaccccgcgcccgactccctaaaaacgccgcaaatactaaacgactacgacgcctaaacgccgactaccccgcaaatacgaacgaaaaaacgaaaaatccccgcctcccgatccgaccccgaccccgcgcctcacctacgccgccgaaacccgcgctccgcaacccaacccgacccgaccgccgcgaacgcttcctactcgcgacttcctaaaacgacgcgcgaaaaaccccgccgccctttcactttccctaacccgcgaaacgccgacgaaaccgcgcgactcctccccctccccgaccgccgcgacccccgactccgaccccgaccccgacgtacccaaaatcgcaccaaccccgaaaccaccgaacgaaaacgcccccacgccttacgacactacccgacctttacgaacgaacccgaatcataacccgcgccttccccgactccgaaaacgcacgaactttcgctaacgcg

SEQ ID NO: 40655 - DNA, 774 bp, Artificial Sequence
  chemically treated genomic DNA (Homo sapiens) CpG-island No: 40655
gggtaggggattcggttggatagttaagttcgtttttgtcggggatttcgtggagcggttgtcggtttcgtgttcgttttttttgtttttattttttcggaattttagcgttgtttcggttcgggaacgttcggtattgtcgtcgagggttatttttttagatgtcgtattttaaagattttttttcgcgaaaatagtttgagatcgttttcggttttcggaaaatatttaaattagtttttattttttttcgaaaaaaaagaaaaggaaggagaggagtcgagtttcgagtgcgtagggtttcgcgttcggttttttgagggcgtcgtaggtgttgagcggttgcggcgtttgagcgtcggttgtttcgtaggtgcgggcgggggggcggggggttttcgtttttcggttcggtttcggtttcgcgttttatttgcgtcgtcgaggttcgcgtttcgtagtttagttcggttcggtcgtcgcgggcgttttttgttcgcgattttttggagcggcgcgcgggaggtttcgtcgtttttttattttttttggttcgcggggcgtcggcggagtcgcgcggttttttttttttttcggtcgtcgcgattttcggtttcggtttcggtttcggcgtgtttagggtcgtattagtttcggggttatcgggcgggggcgtttttacgttttgcggtattgttcggtttttgcgggcgaattcgggttatggttcgcgtttttttcggtttcgagggcgtacgggttttcgttggcgcg

SEQ ID NO: 40656 - DNA, 774 bp, Artificial Sequence
  chemically treated genomic DNA (Homo sapiens) CpG-island No: 40656
cgcgccaacgaaaacccgtacgccctcgaaaccgaaaaaaacgcgaaccataacccgaattcgcccgcaaaaaccgaacaataccgcaaaacgtaaaaacgcccccgcccgataaccccgaaactaatacgaccctaaacacgccgaaaccgaaaccgaaaccgaaaatcgcgacgaccgaaaaaaaaaaaaaaccgcgcgactccgccgacgccccgcgaaccaaaaaaaataaaaaaacgacgaaacctcccgcgcgccgctccaaaaaatcgcgaacaaaaaacgcccgcgacgaccgaaccgaactaaactacgaaacgcgaacctcgacgacgcaaataaaacgcgaaaccgaaaccgaaccgaaaaacgaaaaccccccgcccccccgcccgcacctacgaaacaaccgacgctcaaacgccgcaaccgctcaacacctacgacgccctcaaaaaaccgaacgcgaaaccctacgcactcgaaactcgactcctctccttccttttcttttttttcgaaaaaaaataaaaactaatttaaatattttccgaaaaccgaaaacgatctcaaactattttcgcgaaaaaaaatctttaaaatacgacatctaaaaaaataaccctcgacgacaataccgaacgttcccgaaccgaaacaacgctaaaattccgaaaaaataaaaacaaaaaaaacgaacacgaaaccgacaaccgctccacgaaatccccgacaaaaacgaacttaactatccaaccgaatcccctaccc

SEQ ID NO: 40657 - DNA, 3037 bp, Artificial Sequence
  chemically treated genomic DNA (Homo sapiens) CpG-island No: 40657
gagaagcgagtattaatattaagtttgtcgcgttatttatatttacgtatgcgtttttttttatttgtatcgagtttttcgtttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgagtttttcgtttcgtttatatttacgtaggcgtttttttttatttgtatcgagtttttcgtttcgtttatatttacgtaggcgtttttttttatttgtatcgagtttttcgtttcgtttatatttacgtaggcgtttttttttatttgtatcgagtttttcgtttcgtttatatttacgtaggcgtttttttttatttatatcgagtttttcgtttcgtttatatttacgtaggcgtttttttttatttgtatcgagtttttcgtttcgtttatatttacgtaggcgtttttttttatttgtatcgagtttttcgtttcgtttatatttacgtaggcgtttttttttatttgtatcgagtttgtcgtttcgtttatatttacgtaggcgtttttttttatttgtatcgagtttgtcgtttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgagtttgtcgtttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgagtttttattttcgtttatatttatgtaggcgtttttttttatttgtatcgagtttttcgtttcgtttatatttacgtaggcgtttttttttatttgtatcgagtttttcgtttcgtttatatttacgtaggcgtttttttttatttgtatcgagtttttcgttcggtttatatttacgtaggcgtttttttttatttgtatcgagtttttcgtttcgtttatatttacgtaggcgtttttttttatttgtatcgagtttttcgtttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgagtttgtcgtttcgtttatatttacgtaggcgttgttttttatttgtatcgagtttgtcgtttcgtttatatttacgtaggcgtttttttttatttgtatcgagtttttattttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgggtttgtcgtttcgtttatatttacgtaggcgtttttttttatttgtatcgagtttttattttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgagtttttattttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgagtttttattttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgggtttgtcgtttcgtttatatttacgtatgcgtttttttttatttgtattgggtttgttattttgtttatatttatgtttgcgttttttttttgtttttttaatttaga

SEQ ID NO: 40658 - DNA, 3037 bp, Artificial Sequence
  chemically treated genomic DNA (Homo sapiens) CpG-island No: 40658
tctaaattaaaaaaacaaaaaaaaaacgcaaacataaatataaacaaaataacaaacccaatacaaataaaaaaaaacgcatacgtaaatataaacgaaacgacaaacccgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaaataaaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaaataaaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaaataaaaactcgatacaaataaaaaaaaacgcctacgtaaatataaacgaaacgacaaacccgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaaataaaaactcgatacaaataaaaaaaaacgcctacgtaaatataaacgaaacgacaaactcgatacaaataaaaaacaacgcctacgtaaatataaacgaaacgacaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaacgaaaaactcgatacaaataaaaaaaaacgcctacgtaaatataaacgaaacgaaaaactcgatacaaataaaaaaaaacgcctacgtaaatataaaccgaacgaaaaactcgatacaaataaaaaaaaacgcctacgtaaatataaacgaaacgaaaaactcgatacaaataaaaaaaaacgcctacgtaaatataaacgaaacgaaaaactcgatacaaataaaaaaaaacgcctacataaatataaacgaaaataaaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaacgacaaactcgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaacgacaaactcgatacaaataaaaaaaaacgcctacgtaaatataaacgaaacgacaaactcgatacaaataaaaaaaaacgcctacgtaaatataaacgaaacgaaaaactcgatacaaataaaaaaaaacgcctacgtaaatataaacgaaacgaaaaactcgatacaaataaaaaaaaacgcctacgtaaatataaacgaaacgaaaaactcgatataaataaaaaaaaacgcctacgtaaatataaacgaaacgaaaaactcgatacaaataaaaaaaaacgcctacgtaaatataaacgaaacgaaaaactcgatacaaataaaaaaaaacgcctacgtaaatataaacgaaacgaaaaactcgatacaaataaaaaaaaacgcctacgtaaatataaacgaaacgaaaaactcgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcatacgtaaatataaataacgcgacaaacttaatattaatactcgcttctc

SEQ ID NO: 40659 - DNA, 3037 bp, Artificial Sequence
  chemically treated genomic DNA (Homo sapiens) CpG-island No: 40659
tttggattgaaaaggtaagaggaaaacgtaggtatagatataaatagggtggtaggtttagtgtaggtaaggggaaacgtatgcgtggatgtaaacggggcggtaggttcggtgtaggtaaggggaaacgtttgcgtggatataaacggggcgggaggttcggtgtaggtaaggggaaacgtttgcgtggatataaacgggaatggaggttcggtgtaggtaaggggaaacgtttgcgtggatataaacgggaatggaggttcggtgtaggtaaggggaaacgtttgcgtggatataaacgggaatggaggttcggtgtaggtaaggggaaacgtttgcgtggatgtaaacggggcgggaggttcggtgtaggtaaggggaaacgtttgcgtggatataaacgggaatggaggttcggtgtaggtaaggggaaacgtttgcgtggatgtaaacggggcgggaggttcggtgtaggtaaggggaaacgtttgcgtggatataaacgggaatggaggttcggtgtaggtaaggggaaacgtttgcgtggatgtaaacggggcgggaggttcggtgtaggtaaggggaaacgtttgcgtggatataaacgggaatggaggttcggtgtaggtaaggggaaacgtttgcgtggatataaacgggaatggaggttcggtgtaggtaaggggaaacgtttgcgtggatataaacgggaatggaggttcggtgtaggtaaggggaaacgtttgcgtggatgtaaacggggcgggaggttcggtgtaggtaaggggaaacgtttgcgtggatataaacgggaatggaggttcggtgtaggtaaggggaaacgtttgcgtggatgtaaacggggcgggaggttcggtgtaggtaaggggaaacgtttgcgtggatataaacgggaatggaggttcggtgtaggtaaggggaaacgtttgcgtggatgtaaacggggcgggaggttcggtgtaggtaaggggaaacgtttgcgtggatataaacgggaatggaggttcggtgtaggtaaggggaaacgtttgcgtggatataaacgggaatggaggttcggtgtaggtaaggggaaacgtttgcgtggatgtaaacggggcggtaggttcggtgtaggtaaggggaaacgtttgcgtggatataaacgggaatggaggttcggtgtaggtaaggggaaacgtttgcgtggatgtaaacggggcgggaggttcggtgtaggtaaggggaaacgtttgcgtggatataaacgggaatggaggttcggtgtaggtaaggggaaacgtttgcgtggatgtaaacggggcgggaggttcggtgtaggtaaggggaaacgtttgcgtggatataaacgggaatggaggttcggtgtaggtaaggggaaacgtttgcgtggatataaacgggaatggaggttcggtgtaggtaaggggaaacgtttgcgtggatgtaaacggggcggtaggttcggtgtaggtaaggggtaacgtttgcgtggatgtaaacggggcggtaggttcggtgtaggtaaggggaaacgtttgcgtggatataaacgggaatggaggttcggtgtaggtaaggggaaacgtttgcgtggatgtaaacggggcgggaggttcggtgtaggtaaggggaaacgtttgcgtggatgtaaacggggcgggaggttcggtgtaggtaaggggaaacgtttgcgtggatgtaaacggggcgggaggttcggtgtaggtaaggggaaacgtttgcgtggatgtaaatcgggcgggaggttcggtgtaggtaaggggaaacgtttgcgtggatgtaaacggggcgggaggttcggtgtaggtaaggggaaacgtttgcgtggatgtaaacggggcgggaggttcggtgtaggtaaggggaaacgtttgtatggatataaacgggaatggaggttcggtgtaggtaaggggaaacgtttgcgtggatgtaaacgggaatggaggttcggtgtaggtaaggggaaacgtttgcgtggatgtaaacggggcgggaggttcggtgtaggtaaggggaaacgtttgcgtggatgtaaacgggaatggaggttcggtgtaggtaaggggaaacgtttgcgtggatataaacggggcgggaggttcggtgtaggtaaggggaaacgtttgcgtggatgtaaacggggcggtaggttcggtgtaggtaaggggaaacgtttgcgtggatgtaaacggggcgggaggttcggtgtaggtaaggggaaacgtttgcgtggatgtaaacgggaatggaggttcggtgtaggtaaggggaaacgtttgcgtggatataaacggggcgggaggttcggtgtaggtaaggggaaacgtttgcgtggatgtaaacggggcggtaggttcggtgtaggtaaggggaaacgtttgcgtggatgtaaacggggcggtaggttcggtgtaggtaaggggaaacgtttgcgtggatgtaaacggggcgggaggttcggtgtaggtaaggggaaacgtttgcgtggatgtaaacggggcgggaggttcggtgtaggtaaggggaaacgtttgcgtggatgtaaacggggcgggaggttcggtgtaggtaaggggaaacgtttgcgtggatgtaaacggggcgggaggttcggtgtaggtaaggggaaacgtttgcgtggatgtaaacggggcgggaggttcggtgtaggtaaggggaaacgtttgcgtggatgtaaacggggcgggaggttcggtgtaggtaaggggaaacgtttgcgtggatgtaaacggggcgggaggttcggtgtaggtaaggggaaacgtttgcgtggatgtaaacggggcgggaggttcggtgtaggtaaggggaaacgtttgcgtggatataaacgggaatggaggttcggtgtaggtaaggggaaacgtttgcgtggatgtaaacggggcgggaggttcggtgtaggtaaggggaaacgtatgcgtggatataaatggcgcggtaggtttgatgttggtattcgtttttt

SEQ ID NO: 40660 - DNA, 3037 bp, Artificial Sequence
  chemically treated genomic DNA (Homo sapiens) CpG-island No: 40660
aaaaaacgaataccaacatcaaacctaccgcgccatttatatccacgcatacgtttccccttacctacaccgaacctcccgccccgtttacatccacgcaaacgtttccccttacctacaccgaacctccattcccgtttatatccacgcaaacgtttccccttacctacaccgaacctcccgccccgtttacatccacgcaaacgtttccccttacctacaccgaacctcccgccccgtttacatccacgcaaacgtttccccttacctacaccgaacctcccgccccgtttacatccacgcaaacgtttccccttacctacaccgaacctcccgccccgtttacatccacgcaaacgtttccccttacctacaccgaacctcccgccccgtttacatccacgcaaacgtttccccttacctacaccgaacctcccgccccgtttacatccacgcaaacgtttccccttacctacaccgaacctcccgccccgtttacatccacgcaaacgtttccccttacctacaccgaacctcccgccccgtttacatccacgcaaacgtttccccttacctacaccgaacctaccgccccgtttacatccacgcaaacgtttccccttacctacaccgaacctaccgccccgtttacatccacgcaaacgtttccccttacctacaccgaacctcccgccccgtttatatccacgcaaacgtttccccttacctacaccgaacctccattcccgtttacatccacgcaaacgtttccccttacctacaccgaacctcccgccccgtttacatccacgcaaacgtttccccttacctacaccgaacctaccgccccgtttacatccacgcaaacgtttccccttacctacaccgaacctcccgccccgtttatatccacgcaaacgtttccccttacctacaccgaacctccattcccgtttacatccacgcaaacgtttccccttacctacaccgaacctcccgccccgtttacatccacgcaaacgtttccccttacctacaccgaacctccattcccgtttacatccacgcaaacgtttccccttacctacaccgaacctccattcccgtttatatccatacaaacgtttccccttacctacaccgaacctcccgccccgtttacatccacgcaaacgtttccccttacctacaccgaacctcccgccccgtttacatccacgcaaacgtttccccttacctacaccgaacctcccgcccgatttacatccacgcaaacgtttccccttacctacaccgaacctcccgccccgtttacatccacgcaaacgtttccccttacctacaccgaacctcccgccccgtttacatccacgcaaacgtttccccttacctacaccgaacctcccgccccgtttacatccacgcaaacgtttccccttacctacaccgaacctccattcccgtttatatccacgcaaacgtttccccttacctacaccgaacctaccgccccgtttacatccacgcaaacgttaccccttacctacaccgaacctaccgccccgtttacatccacgcaaacgtttccccttacctacaccgaacctccattcccgtttatatccacgcaaacgtttccccttacctacaccgaacctccattcccgtttatatccacgcaaacgtttccccttacctacaccgaacctcccgccccgtttacatccacgcaaacgtttccccttacctacaccgaacctccattcccgtttatatccacgcaaacgtttccccttacctacaccgaacctcccgccccgtttacatccacgcaaacgtttccccttacctacaccgaacctccattcccgtttatatccacgcaaacgtttccccttacctacaccgaacctaccgccccgtttacatccacgcaaacgtttccccttacctacaccgaacctccattcccgtttatatccacgcaaacgtttccccttacctacaccgaacctccattcccgtttatatccacgcaaacgtttccccttacctacaccgaacctcccgccccgtttacatccacgcaaacgtttccccttacctacaccgaacctccattcccgtttatatccacgcaaacgtttccccttacctacaccgaacctcccgccccgtttacatccacgcaaacgtttccccttacctacaccgaacctccattcccgtttatatccacgcaaacgtttccccttacctacaccgaacctcccgccccgtttacatccacgcaaacgtttccccttacctacaccgaacctccattcccgtttatatccacgcaaacgtttccccttacctacaccgaacctccattcccgtttatatccacgcaaacgtttccccttacctacaccgaacctccattcccgtttatatccacgcaaacgtttccccttacctacaccgaacctcccgccccgtttacatccacgcaaacgtttccccttacctacaccgaacctccattcccgtttatatccacgcaaacgtttccccttacctacaccgaacctcccgccccgtttacatccacgcaaacgtttccccttacctacaccgaacctccattcccgtttatatccacgcaaacgtttccccttacctacaccgaacctcccgccccgtttacatccacgcaaacgtttccccttacctacaccgaacctccattcccgtttatatccacgcaaacgtttccccttacctacaccgaacctccattcccgtttatatccacgcaaacgtttccccttacctacaccgaacctccattcccgtttatatccacgcaaacgtttccccttacctacaccgaacctcccgccccgtttatatccacgcaaacgtttccccttacctacaccgaacctaccgccccgtttacatccacgcatacgtttccccttacctacactaaacctaccaccctatttatatctatacctacgttttcctcttaccttttcaatccaaa

SEQ ID NO: 40661 - DNA, 905 bp, Artificial Sequence
  chemically treated genomic DNA (Homo sapiens) CpG-island No: 40661
ggacggaattgagaagcgagtattaatattaagtttgtcgcgttatttatatttacgtatgcgtttttttttatttgtatcgagtttttcgtttcgtttatatttacgtaggcgtttttttttatttgtatcgagtttttattttcgtttatatttacgtaggcgtttttttttatttgtatcgagtttgtcgtttcgtttatatttacgtaggcgtttttttttatttgtattgagtttttcgtttcgtttatatttacgtaggcgtttttttttatttgtatcgagtttttcgtttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgagtttttcgtttcgtttatatttacgtaggcgtttttttttatttgtatcgagtttttattttcgtttatatttacgtaggcgtttttttttatttgtatcgagtttttattttcgtttatatttacgtaggcgtttttttttatttgtatcgagtttttcgtttcgtttatatttacgtaggcgtttttttttatttgtatcgggtttttattttcgtttatatttacgtaggcgtttttttttatttgtatcgagtttttattttcgtttatatttacgtaggcgtttttttttatttgtatcgggtttgtcgtttcgtttatatttacgtatgcgtttttttttatttgtattgggtttgttattttgtttatatttatgtttgcgttttttttttgtttttttaatttaga

SEQ ID NO: 40662 - DNA, 905 bp, Artificial Sequence
  chemically treated genomic DNA (Homo sapiens) CpG-island No: 40662
tctaaattaaaaaaacaaaaaaaaaacgcaaacataaatataaacaaaataacaaacccaatacaaataaaaaaaaacgcatacgtaaatataaacgaaacgacaaacccgatacaaataaaaaaaaacgcctacgtaaatataaacgaaaataaaaactcgatacaaataaaaaaaaacgcctacgtaaatataaacgaaaataaaaacccgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaacgaaaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcctacgtaaatataaacgaaacgaaaaactcgatacaaataaaaaaaaacgcctacgtaaatataaacgaaacgaaaaactcaatacaaataaaaaaaaacgcctacgtaaatataaacgaaacgacaaactcgatacaaataaaaaaaaacgcctacgtaaatataaacgaaaataaaaactcgatacaaataaaaaaaaacgcctacgtaaatataaacgaaacgaaaaactcgatacaaataaaaaaaaacgcatacgtaaatataaataacgcgacaaacttaatattaatactcgcttctcaattccgtcc

SEQ ID NO: 40663 - DNA, 905 bp, Artificial Sequence
  chemically treated genomic DNA (Homo sapiens) CpG-island No: 40663
tttggattgaaaaggtaagaggaaaacgtaggtatagatataaatagggtggtaggtttagtgtaggtaaggggaaacgtatgcgtggatgtaaacggggcggtaggttcggtgtaggtaaggggaaacgtttgcgtggatataaacgggaatggaggttcggtgtaggtaaggggaaacgtttgcgtggatataaacgggaatggaggttcggtgtaggtaaggggaaacgtttgcgtggatataaacggggcgggaggttcggtgtaggtaaggggaaacgtttgcgtggatataaacgggaatggaggttcggtgtaggtaaggggaaacgtttgcgtggatgtaaacgggaatggaggttcggtgtaggtaaggggaaacgtttgcgtggatataaacggggcgggaggttcggtgtaggtaaggggaaacgtttgcgtggatgtaaacggggcgggaggttcggtgtaggtaaggggaaacgtttgcgtggatgtaaacgggaatggaggttcggtgtaggtaaggggaaacgtttgcgtggatataaacggggcgggaggttcggtgtaggtaaggggaaacgtttgcgtggatgtaaacggggcgggaggttcggtgtaggtaaggggaaacgtttgcgtggatataaacggggcgggaggtttagtgtaggtaaggggaaacgtttgcgtggatgtaaacggggcggtaggttcggtgtaggtaaggggaaacgtttgcgtggatgtaaacgggaatggaggttcggtgtaggtaaggggaaacgtttgcgtggatgtaaacggggcgggaggttcggtgtaggtaaggggaaacgtatgcgtggatataaatggcgcggtaggtttgatgttggtattcgttttttagtttcgttt

SEQ ID NO: 40664 - DNA, 905 bp, Artificial Sequence
  chemically treated genomic DNA (Homo sapiens) CpG-island No: 40664
aaacgaaactaaaaaacgaataccaacatcaaacctaccgcgccatttatatccacgcatacgtttccccttacctacaccgaacctcccgccccgtttacatccacgcaaacgtttccccttacctacaccgaacctccattcccgtttacatccacgcaaacgtttccccttacctacaccgaacctaccgccccgtttacatccacgcaaacgtttccccttacctacactaaacctcccgccccgtttatatccacgcaaacgtttccccttacctacaccgaacctcccgccccgtttacatccacgcaaacgtttccccttacctacaccgaacctcccgccccgtttatatccacgcaaacgtttccccttacctacaccgaacctccattcccgtttacatccacgcaaacgtttccccttacctacaccgaacctcccgccccgtttacatccacgcaaacgtttccccttacctacaccgaacctcccgccccgtttatatccacgcaaacgtttccccttacctacaccgaacctccattcccgtttacatccacgcaaacgtttccccttacctacaccgaacctccattcccgtttatatccacgcaaacgtttccccttacctacaccgaacctcccgccccgtttatatccacgcaaacgtttccccttacctacaccgaacctccattcccgtttatatccacgcaaacgtttccccttacctacaccgaacctccattcccgtttatatccacgcaaacgtttccccttacctacaccgaacctaccgccccgtttacatccacgcatacgtttccccttacctacactaaacctaccaccctatttatatctatacctacgttttcctcttaccttttcaatccaaa

SEQ ID NO: 40665 - DNA, 989 bp, Artificial Sequence
  chemically treated genomic DNA (Homo sapiens) CpG-island No: 40665
cggcgtatattttatttatatgtagcgtacggttacgtagtgcgtattttatatatatatagcgtacgattacgtggtttgtattttatttatatagtatacgattacgcggcgcgtattttatttatatagcgtataattacgcggcgcgtattttatatagcgtacgattacgcggcgtatattttatttatatagcgtacgattatacggcgcgtattttatatagtatacgattacgcggcgcgtattttatatagtatacgattacgcggcgcgtattttatagtatacgattacgtagcgtgtattttatatatagcgtacgattatatcgcgtattttatatatatagcgtacgattacgcggcgcgtattttatttatatagcgtacgattacgcggcgtatattttatttatatagcgtacgattatacggcgcgtattttatatagtatacgattacgcggcgcgtattttatatagtatacgattacgcggcgcgtattttatatagtatacgattacgcggcgcgtattttatttatagtatacgattatatcgcgtattttatatatatagcgtacgattacgcggcgtatattttatatagtatacgattacgcggcgcgtattttatatagtatacgattacgcggcgcgtattttatttatagtatacgattacgtagcgtgtattttatatatagcgtacgattatatcgcgtattttatatatatagcgtacgattacgcggcgtgtattatatatatagcgtacgattatattacgtattttatatatatatatagcgtacgattacgcggcgcgtattttatatagtatacgattacgtagcgtgtattttatatatatatagcgtataattatatcgcgtattttatatatatatagcgtaggtattaaggagttttgtttggtatattcggttgttgttaaatatttttaggaagttgagaaggttt

SEQ ID NO: 40666 - DNA, 989 bp, Artificial Sequence
  chemically treated genomic DNA (Homo sapiens) CpG-island No: 40666
aaaccttctcaacttcctaaaaatatttaacaacaaccgaatataccaaacaaaactccttaatacctacgctatatatatataaaatacgcgatataattatacgctatatatatataaaatacacgctacgtaatcgtatactatataaaatacgcgccgcgtaatcgtacgctatatatatatataaaatacgtaatataatcgtacgctatatatataatacacgccgcgtaatcgtacgctatatatataaaatacgcgatataatcgtacgctatatataaaatacacgctacgtaatcgtatactataaataaaatacgcgccgcgtaatcgtatactatataaaatacgcgccgcgtaatcgtatactatataaaatatacgccgcgtaatcgtacgctatatatataaaatacgcgatataatcgtatactataaataaaatacgcgccgcgtaatcgtatactatataaaatacgcgccgcgtaatcgtatactatataaaatacgcgccgcgtaatcgtatactatataaaatacgcgccgtataatcgtacgctatataaataaaatatacgccgcgtaatcgtacgctatataaataaaatacgcgccgcgtaatcgtacgctatatatataaaatacgcgatataatcgtacgctatatataaaatacacgctacgtaatcgtatactataaaatacgcgccgcgtaatcgtatactatataaaatacgcgccgcgtaatcgtatactatataaaatacgcgccgtataatcgtacgctatataaataaaatatacgccgcgtaatcgtacgctatataaaatacgcgccgcgtaattatacgctatataaataaaatacgcgccgcgtaatcgtatactatataaataaaatacaaaccacgtaatcgtacgctatatatatataaaatacgcactacgtaaccgtacgctacatataaataaaatatacgccg

SEQ ID NO: 40667 - DNA, 989 bp, Artificial Sequence
  chemically treated genomic DNA (Homo sapiens) CpG-island No: 40667
gaatttttttaattttttaggaatgtttagtagtaatcgaatatattaggtaaaattttttggtgtttgcgttgtgtgtgtgtgaggtgcgcggtgtgattgtgcgttgtgtgtgtgtgaggtgtacgttgcgtgatcgtgtgttgtgtgaggtgcgcgtcgcgtgatcgtgcgttgtgtgtgtgtgtgaggtgcgtggtgtgatcgtgcgttgtgtgtgtggtgtacgtcgcgtgatcgtgcgttgtgtgtgtgaggtgcgcggtgtgatcgtgcgttgtgtgtgaggtgtacgttgcgtgatcgtgtgttgtgagtgaggtgcgcgtcgcgtgatcgtgtgttgtgtgaggtgcgcgtcgcgtgatcgtgtgttgtgtgaggtgtgcgtcgcgtgatcgtgcgttgtgtgtgtgaggtgcgcggtgtgatcgtgtgttgtgagtgaggtgcgcgtcgcgtgatcgtgtgttgtgtgaggtgcgcgtcgcgtgatcgtgtgttgtgtgaggtgcgcgtcgcgtgatcgtgtgttgtgtgaggtgcgcgtcgtgtgatcgtgcgttgtgtgagtgaggtgtgcgtcgcgtgatcgtgcgttgtgtgagtgaggtgcgcgtcgcgtgatcgtgcgttgtgtgtgtgaggtgcgcggtgtgatcgtgcgttgtgtgtgaggtgtacgttgcgtgatcgtgtgttgtgaggtgcgcgtcgcgtgatcgtgtgttgtgtgaggtgcgcgtcgcgtgatcgtgtgttgtgtgaggtgcgcgtcgtgtgatcgtgcgttgtgtgagtgaggtgtgcgtcgcgtgatcgtgcgttgtgtgaggtgcgcgtcgcgtgattgtgcgttgtgtgagtgaggtgcgcgtcgcgtgatcgtgtgttgtgtgagtgaggtgtaggttacgtgatcgtgcgttgtgtgtgtgtgaggtgcgtattgcgtgatcgtgcgttgtatgtgagtgaggtgtgcgtcg

SEQ ID NO: 40668 - DNA, 989 bp, Artificial Sequence
  chemically treated genomic DNA (Homo sapiens) CpG-island No: 40668
cgacgcacacctcactcacatacaacgcacgatcacgcaatacgcacctcacacacacacaacgcacgatcacgtaacctacacctcactcacacaacacacgatcacgcgacgcgcacctcactcacacaacgcacaatcacgcgacgcgcacctcacacaacgcacgatcacgcgacgcacacctcactcacacaacgcacgatcacacgacgcgcacctcacacaacacacgatcacgcgacgcgcacctcacacaacacacgatcacgcgacgcgcacctcacaacacacgatcacgcaacgtacacctcacacacaacgcacgatcacaccgcgcacctcacacacacaacgcacgatcacgcgacgcgcacctcactcacacaacgcacgatcacgcgacgcacacctcactcacacaacgcacgatcacacgacgcgcacctcacacaacacacgatcacgcgacgcgcacctcacacaacacacgatcacgcgacgcgcacctcacacaacacacgatcacgcgacgcgcacctcactcacaacacacgatcacaccgcgcacctcacacacacaacgcacgatcacgcgacgcacacctcacacaacacacgatcacgcgacgcgcacctcacacaacacacgatcacgcgacgcgcacctcactcacaacacacgatcacgcaacgtacacctcacacacaacgcacgatcacaccgcgcacctcacacacacaacgcacgatcacgcgacgtacaccacacacacaacgcacgatcacaccacgcacctcacacacacacacaacgcacgatcacgcgacgcgcacctcacacaacacacgatcacgcaacgtacacctcacacacacacaacgcacaatcacaccgcgcacctcacacacacacaacgcaaacaccaaaaaattttacctaatatattcgattactactaaacattcctaaaaaattaaaaaaattc

SEQ ID NO: 40669 - DNA, 835 bp, Artificial Sequence
  chemically treated genomic DNA (Homo sapiens) CpG-island No: 40669
agcgttcgggtggatatgtaagtcggtttagcgtagacgtttgagaggggtgtttagtagttttcgtaggttttcgtcgcgttttcgttatagcgtttaggcgttcgtagggtatagggatcggtattagtcggtgacgtgttttttacgttgttgtttgtgattggtggtttcgattcggggcgtggttttaagggaggtatttagttttattggggatgcgcgcgtagatttacggtttttgtttcgtttttagttggtttgtaattggcgtagtcggtttaaggggcggttgtttaggcgcgggtgcgcgcgtagttgttgtggttttgtttggtgcgttcgttgttatcgttatggttgtttcgtgtttgttgcggtaaggacgagtcggggcgttgaaggtaaaggaggagttagtttgggttggttgcgcggtttcgagtttacgtaggggatggggtgagggggcgcggtgttggttaggttcgggtttgttcgcgatttttagtcgttttagttgggtcgttgatttcgttttttgggtttaggattgatcgttacggggttaggttcggatgtggttagcgagcgtttcgcggttttttcgagtcggttcgtcgtcgtcgttgttcgaggtttaggtcgaggttggcgtgtttcgtgtcgacgggcgttttcgagggttgtatgtttgggcggtagattcgggtggacgtttttaggtgatgttgtcgcgcggttggggttagtcgttgtgcggttttcgtacggtttttttgaaggatagtgatttttttatttagttaagagaggaaatgagggaatttttagg

SEQ ID NO: 40670 - DNA, 835 bp, Artificial Sequence
  chemically treated genomic DNA (Homo sapiens) CpG-island No: 40670
cctaaaaattccctcatttcctctcttaactaaataaaaaaatcactatccttcaaaaaaaccgtacgaaaaccgcacaacgactaaccccaaccgcgcgacaacatcacctaaaaacgtccacccgaatctaccgcccaaacatacaaccctcgaaaacgcccgtcgacacgaaacacgccaacctcgacctaaacctcgaacaacgacgacgacgaaccgactcgaaaaaaccgcgaaacgctcgctaaccacatccgaacctaaccccgtaacgatcaatcctaaacccaaaaaacgaaatcaacgacccaactaaaacgactaaaaatcgcgaacaaacccgaacctaaccaacaccgcgccccctcaccccatcccctacgtaaactcgaaaccgcgcaaccaacccaaactaactcctcctttaccttcaacgccccgactcgtccttaccgcaacaaacacgaaacaaccataacgataacaacgaacgcaccaaacaaaaccacaacaactacgcgcgcacccgcgcctaaacaaccgccccttaaaccgactacgccaattacaaaccaactaaaaacgaaacaaaaaccgtaaatctacgcgcgcatccccaataaaactaaatacctcccttaaaaccacgccccgaatcgaaaccaccaatcacaaacaacaacgtaaaaaacacgtcaccgactaataccgatccctataccctacgaacgcctaaacgctataacgaaaacgcgacgaaaacctacgaaaactactaaacacccctctcaaacgtctacgctaaaccgacttacatatccacccgaacgct

SEQ ID NO: 40671 - DNA, 835 bp, Artificial Sequence
  chemically treated genomic DNA (Homo sapiens) CpG-island No: 40671
tttgaaagtttttttatttttttttttggttaaatggagaagttattgttttttagagaagtcgtgcgggagtcgtatagcggttgattttagtcgcgcggtagtattatttgggaacgtttattcgagtttgtcgtttaggtatgtagttttcgggagcgttcgtcggtacggggtacgttagtttcggtttgggtttcgggtagcggcggcggcggatcggttcgggggaatcgcgggacgttcgttggttatattcgggtttggtttcgtggcggttagttttgggtttagggagcggggttagcggtttaattaggacggttagaggtcgcggataggttcggatttgattagtatcgcgtttttttattttattttttacgtaggttcggggtcgcgtagttagtttaggttggttttttttttatttttagcgtttcggttcgtttttgtcgtagtaaatacggggtagttatggcggtgatagcgggcgtattaagtagggttatagtagttgcgcgcgtattcgcgtttgaatagtcgttttttgggtcgattgcgttaattataggttagttgggggcggagtagaggtcgtgggtttgcgcgcgtatttttagtagggttaagtgttttttttggggttacgtttcggatcgggattattaattataggtagtagcgtgagggatacgttatcggttggtgtcgatttttgtgttttgcgggcgtttgggcgttgtggcgggggcgcggcggagatttgcgggggttgttgggtattttttttaggcgtttgcgttgggtcggtttgtatgtttattcgaacgtt

SEQ ID NO: 40672 - DNA, 835 bp, Artificial Sequence
  chemically treated genomic DNA (Homo sapiens) CpG-island No: 40672
aacgttcgaataaacatacaaaccgacccaacgcaaacgcctaaaaaaaatacccaacaacccccgcaaatctccgccgcgcccccgccacaacgcccaaacgcccgcaaaacacaaaaatcgacaccaaccgataacgtatccctcacgctactacctataattaataatcccgatccgaaacgtaaccccaaaaaaaacacttaaccctactaaaaatacgcgcgcaaacccacgacctctactccgcccccaactaacctataattaacgcaatcgacccaaaaaacgactattcaaacgcgaatacgcgcgcaactactataaccctacttaatacgcccgctatcaccgccataactaccccgtatttactacgacaaaaacgaaccgaaacgctaaaaataaaaaaaaaaccaacctaaactaactacgcgaccccgaacctacgtaaaaaataaaataaaaaaacgcgatactaatcaaatccgaacctatccgcgacctctaaccgtcctaattaaaccgctaaccccgctccctaaacccaaaactaaccgccacgaaaccaaacccgaatataaccaacgaacgtcccgcgattcccccgaaccgatccgccgccgccgctacccgaaacccaaaccgaaactaacgtaccccgtaccgacgaacgctcccgaaaactacatacctaaacgacaaactcgaataaacgttcccaaataatactaccgcgcgactaaaatcaaccgctatacgactcccgcacgacttctctaaaaaacaataacttctccatttaaccaaaaaaaaaaataaaaaaactttcaaa

SEQ ID NO: 40673 - DNA, 1396 bp, Artificial Sequence
  chemically treated genomic DNA (Homo sapiens) CpG-island No: 40673
ttcggttacgggacgttcggcggtggggttacggatggtatagtttttttttttcgtttgttcgaggtaaatggtttcgttcggttatatatattttttttgggcggtaatcgagggcgcggagggggtaagacgtgcgttgaggttacgtttttattgtatagttataaggcgggaggttttgttttcggggcggggtagatagtttttcgcgttcgggcgcggtcggttgggggtacggtttagtttcgggtgcgggcggggttggaggcggggtcggttatcgttcggttttcgttttcgttttttttttttagcgattaggtttcgtttcgcgttcgtcgtcgcgtagggaggggcggggttcgttttcggtaggtttcgttttttttttgaatattgatgcggcgcgcgtcggcgtcgttttttttttattgagcgaggttgtgtcgcgtggtttagcgtcggcgtgacggttggacgcgggcgcggtattgcgggtttcgattgttgtagtcgtttgttagtgtgatgaagattggtatttaggtaagttgttatttaatcgtttcgtcgtcgtcgtcgtcgttttcgtcgtcgtcgtttttattaattatatcggttcgcggtcgtcgttcgtcgtcgtcgttgtcgttcgggtttggagggtcggcgttgttttcgagggttcgtatttgattcgtcgttcggggtagggggcggggagggggcgcgggtgggggaggggagcgggtattcgcgggggagggggcgtttttagtttaatcggcgcgggggcgcgtttagttggttttttagtgtgggttgagggacgcggaaatttttggaaggcgtcgtcgtcgtcgcgttgggtttgatcgaagcgcgcgtttttaatcgtttttttcggagtgcggcgcgcgtttcggcgcggggcgggggcgcgcggagttcggcgcgggcggggcggcgggcgtgagggtcgggggcgcgcggcggggcggggtcggggcgggcggcgcgcgtggggtcggtcgggttcgcggtttcgcggagtttttagggtcggcggggttgttcggagggtgcggggcgcgcggcggcgtaggcgggaagatggcggtcgcgatttcggtttcggtttcggtcgtggcgagcgggtgggtcggggttttgggggcggtgggcgtgatggggttcgtggtttttagtcgggcgtcggcgcgggagtagtttagggtcgttcgttgacggtagtgtttggggtcgggtgttggggaagcggtttcggcgtttcgggaattggtgggaagagtcgtttttgttatacgggtcgtggtaatggatgataggaagtgtcgggtagggtttgggcgttttgtgggtttgtattttt

SEQ ID NO: 40674 - DNA, 1396 bp, Artificial Sequence
  chemically treated genomic DNA (Homo sapiens) CpG-island No: 40674
aaaaatacaaacccacaaaacgcccaaaccctacccgacacttcctatcatccattaccacgacccgtataacaaaaacgactcttcccaccaattcccgaaacgccgaaaccgcttccccaacacccgaccccaaacactaccgtcaacgaacgaccctaaactactcccgcgccgacgcccgactaaaaaccacgaaccccatcacgcccaccgcccccaaaaccccgacccacccgctcgccacgaccgaaaccgaaaccgaaatcgcgaccgccatcttcccgcctacgccgccgcgcgccccgcaccctccgaacaaccccgccgaccctaaaaactccgcgaaaccgcgaacccgaccgaccccacgcgcgccgcccgccccgaccccgccccgccgcgcgcccccgaccctcacgcccgccgccccgcccgcgccgaactccgcgcgcccccgccccgcgccgaaacgcgcgccgcactccgaaaaaaacgattaaaaacgcgcgcttcgatcaaacccaacgcgacgacgacgacgccttccaaaaatttccgcgtccctcaacccacactaaaaaaccaactaaacgcgcccccgcgccgattaaactaaaaacgccccctcccccgcgaatacccgctcccctcccccacccgcgccccctccccgccccctaccccgaacgacgaatcaaatacgaaccctcgaaaacaacgccgaccctccaaacccgaacgacaacgacgacgacgaacgacgaccgcgaaccgatataattaataaaaacgacgacgacgaaaacgacgacgacgacgacgaaacgattaaataacaacttacctaaataccaatcttcatcacactaacaaacgactacaacaatcgaaacccgcaataccgcgcccgcgtccaaccgtcacgccgacgctaaaccacgcgacacaacctcgctcaataaaaaaaaaacgacgccgacgcgcgccgcatcaatattcaaaaaaaaaacgaaacctaccgaaaacgaaccccgcccctccctacgcgacgacgaacgcgaaacgaaacctaatcgctaaaaaaaaaaaacgaaaacgaaaaccgaacgataaccgaccccgcctccaaccccgcccgcacccgaaactaaaccgtacccccaaccgaccgcgcccgaacgcgaaaaactatctaccccgccccgaaaacaaaacctcccgccttataactatacaataaaaacgtaacctcaacgcacgtcttaccccctccgcgccctcgattaccgcccaaaaaaaatatatataaccgaacgaaaccatttacctcgaacaaacgaaaaaaaaaaactataccatccgtaaccccaccgccgaacgtcccgtaaccgaa

SEQ ID NO: 40675 - DNA, 1396 bp, Artificial Sequence
  chemically treated genomic DNA (Homo sapiens) CpG-island No: 40675
gaaggtgtaaatttatagggcgtttagattttgttcggtattttttgttatttattattacgattcgtgtgatagaagcggttttttttattaattttcgggacgtcggaatcgtttttttagtattcggttttaaatattgtcgttagcgagcggttttgggttgttttcgcgtcggcgttcggttgagggttacgagttttattacgtttatcgtttttaggatttcgatttattcgttcgttacggtcgaggtcggggtcggggtcgcggtcgttattttttcgtttgcgtcgtcgcgcgtttcgtatttttcgagtagtttcgtcggttttgaggatttcgcgaggtcgcggattcgatcggttttacgcgcgtcgttcgtttcggtttcgtttcgtcgcgcgttttcgatttttacgttcgtcgtttcgttcgcgtcgggtttcgcgcgttttcgtttcgcgtcggggcgcgcgtcgtatttcgaaagggacggttaggagcgcgcgtttcgattaggtttagcgcggcggcggcggcgttttttagaaattttcgcgttttttaatttatattaagaaattaattgggcgcgttttcgcgtcggttgggttgaaggcgttttttttttcgcgggtgttcgttttttttttttattcgcgtttttttttcgttttttgtttcgggcggcgggttaaatgcgggttttcgagggtagcgtcggttttttagattcgggcggtagcggcggcggcgggcggcggtcgcgggtcggtgtgattgatagggacggcggcggcgagagcggcggcggcggcggcggagcggttgagtgatagtttatttgggtgttaatttttattatattgataagcggttgtagtaatcgggattcgtagtgtcgcgttcgcgtttaatcgttacgtcgacgttgggttacgcgatatagtttcgtttaatgggaggagggcgacgtcgacgcgcgtcgtattaatatttagagagggggcggggtttgtcggagacgggtttcgtttttttttgcgcggcggcgggcgcggggcggggtttgatcgttgggggaggagagcgagggcgggaatcgggcggtggtcggtttcgtttttagtttcgttcgtattcggagttaggtcgtgtttttaatcggtcgcgttcgagcgcgaggagttgtttgtttcgtttcgaaggtagagtttttcgttttatgattatgtagtaggggcgtggttttagcgtacgttttgtttttttcgcgttttcggttgtcgtttaggagaggtgtgtgtagtcgggcgaaattatttgtttcgagtaggcggggagggagggttgtattattcgtaattttatcgtcgggcgtttcgtagtcgaa

SEQ ID NO: 40676 - DNA, 1396 bp, Artificial Sequence
  chemically treated genomic DNA (Homo sapiens) CpG-island No: 40676
ttcgactacgaaacgcccgacgataaaattacgaataatacaaccctccctccccgcctactcgaaacaaataatttcgcccgactacacacacctctcctaaacgacaaccgaaaacgcgaaaaaaacaaaacgtacgctaaaaccacgcccctactacataatcataaaacgaaaaactctaccttcgaaacgaaacaaacaactcctcgcgctcgaacgcgaccgattaaaaacacgacctaactccgaatacgaacgaaactaaaaacgaaaccgaccaccgcccgattcccgccctcgctctcctcccccaacgatcaaaccccgccccgcgcccgccgccgcgcaaaaaaaaacgaaacccgtctccgacaaaccccgccccctctctaaatattaatacgacgcgcgtcgacgtcgccctcctcccattaaacgaaactatatcgcgtaacccaacgtcgacgtaacgattaaacgcgaacgcgacactacgaatcccgattactacaaccgcttatcaatataataaaaattaacacccaaataaactatcactcaaccgctccgccgccgccgccgccgctctcgccgccgccgtccctatcaatcacaccgacccgcgaccgccgcccgccgccgccgctaccgcccgaatctaaaaaaccgacgctaccctcgaaaacccgcatttaacccgccgcccgaaacaaaaaacgaaaaaaaaacgcgaataaaaaaaaaaaacgaacacccgcgaaaaaaaaaacgccttcaacccaaccgacgcgaaaacgcgcccaattaatttcttaatataaattaaaaaacgcgaaaatttctaaaaaacgccgccgccgccgcgctaaacctaatcgaaacgcgcgctcctaaccgtccctttcgaaatacgacgcgcgccccgacgcgaaacgaaaacgcgcgaaacccgacgcgaacgaaacgacgaacgtaaaaatcgaaaacgcgcgacgaaacgaaaccgaaacgaacgacgcgcgtaaaaccgatcgaatccgcgacctcgcgaaatcctcaaaaccgacgaaactactcgaaaaatacgaaacgcgcgacgacgcaaacgaaaaaataacgaccgcgaccccgaccccgacctcgaccgtaacgaacgaataaatcgaaatcctaaaaacgataaacgtaataaaactcgtaaccctcaaccgaacgccgacgcgaaaacaacccaaaaccgctcgctaacgacaatatttaaaaccgaatactaaaaaaacgattccgacgtcccgaaaattaataaaaaaaaccgcttctatcacacgaatcgtaataataaataacaaaaaataccgaacaaaatctaaacgccctataaatttacaccttc

SEQ ID NO: 40677 - DNA, 567 bp, Artificial Sequence
  chemically treated genomic DNA (Homo sapiens) CpG-island No: 40677
tcgtcgtcgtgagcggagtagtattttttttcgcgggtcgcgggagttatttacgggaagggatttttcgtttggtataggttttgtttggtttggggcgcgtatgtttcgtcgtcgaattttttagaaagtcgtggattcgaggtttcggtagacgtaggcggtttagcgttttgtttttggtttttcgtttcgttttggagttttttttcgtaaggtaagggattgtcgggaacgtagatcgtaagtcgtcggggttttgtagaatttagaggcgttcggcggaaagttcgttaggcgatttagattcgaattcgcgggttttttaagataatagcgtcgggcggtcggatgtacgtgcgtttcgggaaggcgggtttagttggtatcgtttggtcggtttcgttcgttttttaaattataagatttttttggggttacgacgttttcggggtatttttgtattcgcgcgttagtattttcggaggggtttggggaaggttacgcgtacggagagcgggaaatttttttaggtttttaggtgggagatttagattttattgagat

SEQ ID NO: 40678 - DNA, 567 bp, Artificial Sequence
  chemically treated genomic DNA (Homo sapiens) CpG-island No: 40678
atctcaataaaatctaaatctcccacctaaaaacctaaaaaaatttcccgctctccgtacgcgtaaccttccccaaacccctccgaaaatactaacgcgcgaatacaaaaataccccgaaaacgtcgtaaccccaaaaaaatcttataatttaaaaaacgaacgaaaccgaccaaacgataccaactaaacccgccttcccgaaacgcacgtacatccgaccgcccgacgctattatcttaaaaaacccgcgaattcgaatctaaatcgcctaacgaactttccgccgaacgcctctaaattctacaaaaccccgacgacttacgatctacgttcccgacaatcccttaccttacgaaaaaaaactccaaaacgaaacgaaaaaccaaaaacaaaacgctaaaccgcctacgtctaccgaaacctcgaatccacgactttctaaaaaattcgacgacgaaacatacgcgccccaaaccaaacaaaacctataccaaacgaaaaatcccttcccgtaaataactcccgcgacccgcgaaaaaaaatactactccgctcacgacgacga

SEQ ID NO: 40679 - DNA, 567 bp, Artificial Sequence
  chemically treated genomic DNA (Homo sapiens) CpG-island No: 40679
gttttagtagggtttggattttttatttggaaatttagaggagtttttcgtttttcgtgcgcgtggttttttttaggttttttcgggagtgttggcgcgcgagtgtaggggtgtttcgggaacgtcgtgattttaagggggttttgtggtttaaggagcgaacggaatcggttaggcgatgttagttgaattcgttttttcgggacgtacgtgtattcggtcgttcggcgttgttgttttggggagttcgcgggttcgggtttgggtcgtttggcgagtttttcgtcgagcgtttttgagttttatagagtttcgacggtttgcgatttgcgttttcggtagttttttattttgcgagagagggttttagggcgaggcgaggggttaaaagtaaggcgttgggtcgtttgcgtttgtcggggtttcgggtttacggttttttggaagattcggcggcggagtatgcgcgttttaggttagatagggtttgtgttagacggagagttttttttcgtaggtgattttcgcgattcgcggaggaaggtgttgtttcgtttacggcggcgg

SEQ ID NO: 40680 - DNA, 567 bp, Artificial Sequence
  chemically treated genomic DNA (Homo sapiens) CpG-island No: 40680
ccgccgccgtaaacgaaacaacaccttcctccgcgaatcgcgaaaatcacctacgaaaaaaaactctccgtctaacacaaaccctatctaacctaaaacgcgcatactccgccgccgaatcttccaaaaaaccgtaaacccgaaaccccgacaaacgcaaacgacccaacgccttacttttaacccctcgcctcgccctaaaaccctctctcgcaaaataaaaaactaccgaaaacgcaaatcgcaaaccgtcgaaactctataaaactcaaaaacgctcgacgaaaaactcgccaaacgacccaaacccgaacccgcgaactccccaaaacaacaacgccgaacgaccgaatacacgtacgtcccgaaaaaacgaattcaactaacatcgcctaaccgattccgttcgctccttaaaccacaaaacccccttaaaatcacgacgttcccgaaacacccctacactcgcgcgccaacactcccgaaaaaacctaaaaaaaaccacgcgcacgaaaaacgaaaaactcctctaaatttccaaataaaaaatccaaaccctactaaaac

SEQ ID NO: 40681 - DNA, 646 bp, Artificial Sequence
  chemically treated genomic DNA (Homo sapiens) CpG-island No: 40681
gcgtgtcgttcgcgtaacgatagcgtttatcgttattttatacggttcgttaaaaagggcgatttgtaaatagttattttttatttataatgtagcgaatttaatgttgggtatcgaaacgtgtatttttttcggatttttatttcgcgtttttgttttacgttttaggattcgtcgttagtggggtttatttcgtcggcgcgggggttggggtgggagttcggggttacgtgtacggttagtttttattttttgggcggttaagatcgtaggcgtgggcgtcggtggggcgggggttttgggagattttgtttcgtcgtttttcggtgtagatgatgtaattttgggcggaggcgcggagagggaaatcgggatttagttgagattttttgtttagagaggggagcgagtttcggtggggtcggattttatttggacggatatatggaaaagaggggcgagcggttgtttcgattgcggcgaggcggagacggcgatttcggggtggcggtttcgcggggatttacggcgaggggagtaggcgggcggtgattggcggagaggcgggggcggaggtcggcgtcggttaatgtttcgtggtagagtattcgtttttttagttttttttttattttatttagttcgg

SEQ ID NO: 40682 - DNA, 646 bp, Artificial Sequence
  chemically treated genomic DNA (Homo sapiens) CpG-island No: 40682
ccgaactaaataaaataaaaaaaaaactaaaaaaacgaatactctaccacgaaacattaaccgacgccgacctccgcccccgcctctccgccaatcaccgcccgcctactcccctcgccgtaaatccccgcgaaaccgccaccccgaaatcgccgtctccgcctcgccgcaatcgaaacaaccgctcgcccctcttttccatatatccgtccaaataaaatccgaccccaccgaaactcgctcccctctctaaacaaaaaatctcaactaaatcccgatttccctctccgcgcctccgcccaaaattacatcatctacaccgaaaaacgacgaaacaaaatctcccaaaacccccgccccaccgacgcccacgcctacgatcttaaccgcccaaaaaataaaaactaaccgtacacgtaaccccgaactcccaccccaacccccgcgccgacgaaataaaccccactaacgacgaatcctaaaacgtaaaacaaaaacgcgaaataaaaatccgaaaaaaatacacgtttcgatacccaacattaaattcgctacattataaataaaaaataactatttacaaatcgccctttttaacgaaccgtataaaataacgataaacgctatcgttacgcgaacgacacgc

SEQ ID NO: 40683 - DNA, 646 bp, Artificial Sequence
  chemically treated genomic DNA (Homo sapiens) CpG-island No: 40683
tcgggttgggtggggtggaggaggggttgggggggcgggtgttttgttacgagatattggtcggcgtcggttttcgttttcgttttttcgttaattatcgttcgtttgtttttttcgtcgtgggttttcgcgaggtcgttatttcggggtcgtcgttttcgtttcgtcgtagtcggggtagtcgttcgttttttttttttatgtattcgtttaggtgagattcggttttatcgagattcgtttttttttttggatagaggattttaattgggtttcggttttttttttcgcgttttcgtttagagttgtattatttgtatcgaaaggcggcgagatagggttttttaagattttcgttttatcggcgtttacgtttgcggttttgatcgtttagaagatgggggttggtcgtgtacgtggtttcgggtttttattttagttttcgcgtcggcggagtggattttattggcggcgagttttggagcgtggagtagggacgcggggtgggaattcgggggagatgtacgtttcggtgtttagtattgagttcgttgtattgtggatgggaaatggttgtttgtaaatcgttttttttggcggatcgtgtggggtggcggtaaacgttgtcgttgcgcgggcggtacgt

SEQ ID NO: 40684 - DNA, 646 bp, Artificial Sequence
  chemically treated genomic DNA (Homo sapiens) CpG-island No: 40684
acgtaccgcccgcgcaacgacaacgtttaccgccaccccacacgatccgccaaaaaaaacgatttacaaacaaccatttcccatccacaatacaacgaactcaatactaaacaccgaaacgtacatctcccccgaattcccaccccgcgtccctactccacgctccaaaactcgccgccaataaaatccactccgccgacgcgaaaactaaaataaaaacccgaaaccacgtacacgaccaacccccatcttctaaacgatcaaaaccgcaaacgtaaacgccgataaaacgaaaatcttaaaaaaccctatctcgccgcctttcgatacaaataatacaactctaaacgaaaacgcgaaaaaaaaaaccgaaacccaattaaaatcctctatccaaaaaaaaaaacgaatctcgataaaaccgaatctcacctaaacgaatacataaaaaaaaaaaacgaacgactaccccgactacgacgaaacgaaaacgacgaccccgaaataacgacctcgcgaaaacccacgacgaaaaaaacaaacgaacgataattaacgaaaaaacgaaaacgaaaaccgacgccgaccaatatctcgtaacaaaacacccgcccccccaacccctcctccaccccacccaacccga

SEQ ID NO: 40685 - DNA, 812 bp, Artificial Sequence
  chemically treated genomic DNA (Homo sapiens) CpG-island No: 40685
gaataaacgtgtttacgtttaaaaggttcggatgttttaggtaatttttagcgcggttcgaggcggttttcgggagtcggcgattcggaggttcggacgtcgggcgattagttagttcggattttaaggtcggagaaagttcggtcgcggcgtttcgaaaagagattttatttattttgttcgttttagtttttcgtcgcgcggtttacgaggcggcggtttcggagggcgcgtaaggggtcggaagggttatcgttttttttcgtcgcgcgtttttttttcgttatcgtcgcgtcggttcgtttgggttttttcggtcgtttttttatcgttttaattattttgcgtttcgatcgcgtttaattttcggcggggggtttttatttatttgtttttttcggtgtcgaagatggaggttagatatttcgttattttttattcgtcgtcgtcgttgtcgtcgatattgttgtcgacgtcgtcgattttgtcgacgttttcgggagacgttattcggacgcgacgacgttttttttcgtttcgacgtggtagcgttatttagttaggcgaggtgttgtttgcgcgtgggcgggacgtatgcgcgtagggagtacgtagtgcgcgtgggaggtttcgttttttcggttttgggaattcgcgttttttgtcggtgtttttttcgttcggttttagttttttcgttttttcgttcgttcggcgttggttttgttggattttgcgcgtcggggattgggggttggtagtgtagatcgaattcggggtcgaggggtttttttatagagtcgtttggggtt

SEQ ID NO: 40686 - DNA, 812 bp, Artificial Sequence
  chemically treated genomic DNA (Homo sapiens) CpG-island No: 40686
aaccccaaacgactctataaaaaaacccctcgaccccgaattcgatctacactaccaacccccaatccccgacgcgcaaaatccaacaaaaccaacgccgaacgaacgaaaaaacgaaaaaactaaaaccgaacgaaaaaaacaccgacaaaaaacgcgaattcccaaaaccgaaaaaacgaaacctcccacgcgcactacgtactccctacgcgcatacgtcccgcccacgcgcaaacaacacctcgcctaactaaataacgctaccacgtcgaaacgaaaaaaaacgtcgtcgcgtccgaataacgtctcccgaaaacgtcgacaaaatcgacgacgtcgacaacaatatcgacgacaacgacgacgacgaataaaaaataacgaaatatctaacctccatcttcgacaccgaaaaaaacaaataaataaaaaccccccgccgaaaattaaacgcgatcgaaacgcaaaataattaaaacgataaaaaaacgaccgaaaaaacccaaacgaaccgacgcgacgataacgaaaaaaaaacgcgcgacgaaaaaaaacgataacccttccgaccccttacgcgccctccgaaaccgccgcctcgtaaaccgcgcgacgaaaaactaaaacgaacaaaataaataaaatctcttttcgaaacgccgcgaccgaactttctccgaccttaaaatccgaactaactaatcgcccgacgtccgaacctccgaatcgccgactcccgaaaaccgcctcgaaccgcgctaaaaattacctaaaacatccgaaccttttaaacgtaaacacgtttattc

SEQ ID NO: 40687 - DNA, 812 bp, Artificial Sequence
  chemically treated genomic DNA (Homo sapiens) CpG-island No: 40687
agttttaggcggttttgtggagaagtttttcggtttcgggttcggtttgtattgttagtttttagttttcggcgcgtaggatttagtagggttagcgtcgggcgggcgagaaggcgagagagttagggtcgggcggggagggtatcggtagggggcgcgggtttttaggatcgaaaaggcggagttttttacgcgtattacgtgttttttacgcgtatgcgtttcgtttacgcgtaggtagtatttcgtttgattgggtagcgttgttacgtcggggcggggaagagcgtcgtcgcgttcgggtgacgtttttcgagggcgtcggtagggtcggcggcgtcggtagtagtgtcgacggtagcggcggcggcgggtgggaaatggcggagtatttggtttttattttcggtatcgagaaagataagtgagtgggagtttttcgtcgggggttgggcgcgatcggggcgtagggtggttgaggcggtgggagggcgatcggggaggtttaggcgggtcggcgcggcggtggcgggggaggggcgcgcggcgggaaggagcggtggttttttcggttttttgcgcgtttttcggagtcgtcgtttcgtgggtcgcgcggcggaaaattggagcgggtagaatgaatggggttttttttcggggcgtcgcggtcgagtttttttcggttttggggttcggattggttgatcgttcgacgttcgggttttcgagtcgtcgattttcggaagtcgtttcgagtcgcgttgaaagttgtttggagtattcgggttttttggacgtggatacgtttgttt

SEQ ID NO: 40688 - DNA, 812 bp, Artificial Sequence
  chemically treated genomic DNA (Homo sapiens) CpG-island No: 40688
aaacaaacgtatccacgtccaaaaaacccgaatactccaaacaactttcaacgcgactcgaaacgacttccgaaaatcgacgactcgaaaacccgaacgtcgaacgatcaaccaatccgaaccccaaaaccgaaaaaaactcgaccgcgacgccccgaaaaaaaaccccattcattctacccgctccaattttccgccgcgcgacccacgaaacgacgactccgaaaaacgcgcaaaaaaccgaaaaaaccaccgctccttcccgccgcgcgcccctcccccgccaccgccgcgccgacccgcctaaacctccccgatcgccctcccaccgcctcaaccaccctacgccccgatcgcgcccaacccccgacgaaaaactcccactcacttatctttctcgataccgaaaataaaaaccaaatactccgccatttcccacccgccgccgccgctaccgtcgacactactaccgacgccgccgaccctaccgacgccctcgaaaaacgtcacccgaacgcgacgacgctcttccccgccccgacgtaacaacgctacccaatcaaacgaaatactacctacgcgtaaacgaaacgcatacgcgtaaaaaacacgtaatacgcgtaaaaaactccgccttttcgatcctaaaaacccgcgccccctaccgataccctccccgcccgaccctaactctctcgccttctcgcccgcccgacgctaaccctactaaatcctacgcgccgaaaactaaaaactaacaatacaaaccgaacccgaaaccgaaaaacttctccacaaaaccgcctaaaact

SEQ ID NO: 40689 - DNA, 531 bp, Artificial Sequence
  chemically treated genomic DNA (Homo sapiens) CpG-island No: 40689
atataatcgtttcgtcgattggtttttttatacgttttttacggattcgagtaattatcgagttagaggcgatatacgttttcgtcgataagggtcgtgttttttacgaagatgtttagtttattggttatggcgacgttcggggtcgtagcgtttcgagtaggagcgagtattgttcgggattggcgcgtcgtttttaggttattttcgggagcgtcgagatttcgttcgcggtatcgggatttagtttatgattattttcgggatatagttagtcggggaggggacggggcgggagcggcgagggaagagagggggaggtttgcgcggaggagtatcgttttttttcgtcgggagggggagtttcgggtttttgcgttttgttttttttttcggtcgtttgtaggagtacgaagggagtgtttttttttcgttttttcggttttcgtaatttttttttttatttttttttggttttttttttattttttttgtttttttcgggattttttaagtttgatttgtatttta

SEQ ID NO: 40690 - DNA, 531 bp, Artificial Sequence
  chemically treated genomic DNA (Homo sapiens) CpG-island No: 40690
taaaatacaaatcaaacttaaaaaatcccgaaaaaaacaaaaaaaataaaaaaaaaaccaaaaaaaaataaaaaaaaaaattacgaaaaccgaaaaaacgaaaaaaaaacactcccttcgtactcctacaaacgaccgaaaaaaaaaacaaaacgcaaaaacccgaaactccccctcccgacgaaaaaaaacgatactcctccgcgcaaacctccccctctcttccctcgccgctcccgccccgtcccctccccgactaactatatcccgaaaataatcataaactaaatcccgataccgcgaacgaaatctcgacgctcccgaaaataacctaaaaacgacgcgccaatcccgaacaatactcgctcctactcgaaacgctacgaccccgaacgtcgccataaccaataaactaaacatcttcgtaaaaaacacgacccttatcgacgaaaacgtatatcgcctctaactcgataattactcgaatccgtaaaaaacgtataaaaaaaccaatcgacgaaacgattatat

SEQ ID NO: 40691 - DNA, 531 bp, Artificial Sequence
  chemically treated genomic DNA (Homo sapiens) CpG-island No: 40691
taggatataggttaaatttaggaggtttcgaagagggtagagaaggtgggagaaaagttaggaggaagtgaggggagaagttacggggatcgaggagacgaagaggaggtatttttttcgtgtttttgtagacggtcggggagggagataggacgtaggagttcgggattttttttttcggcgggaggaagcggtgttttttcgcgtaggttttttttttttttttttcgtcgttttcgtttcgtttttttttcgattggttgtgtttcggaagtggttataagttgggtttcgatgtcgcgagcggaatttcggcgttttcggaagtggtttgaaggcggcgcgttagtttcgagtagtgttcgtttttgttcggggcgttgcggtttcgggcgtcgttatgattagtgagttggatattttcgtggggaatacgatttttatcgacgaggacgtgtatcgtttttggttcgatggttattcgggttcgtgaggggcgtgtggggaagttagtcggcggagcggttgtgt

SEQ ID NO: 40692 - DNA, 531 bp, Artificial Sequence
  chemically treated genomic DNA (Homo sapiens) CpG-island No: 40692
acacaaccgctccgccgactaacttccccacacgcccctcacgaacccgaataaccatcgaaccaaaaacgatacacgtcctcgtcgataaaaatcgtattccccacgaaaatatccaactcactaatcataacgacgcccgaaaccgcaacgccccgaacaaaaacgaacactactcgaaactaacgcgccgccttcaaaccacttccgaaaacgccgaaattccgctcgcgacatcgaaacccaacttataaccacttccgaaacacaaccaatcgaaaaaaaaacgaaacgaaaacgacgaaaaaaaaaaaaaaaaaacctacgcgaaaaaacaccgcttcctcccgccgaaaaaaaaaatcccgaactcctacgtcctatctccctccccgaccgtctacaaaaacacgaaaaaaatacctcctcttcgtctcctcgatccccgtaacttctcccctcacttcctcctaacttttctcccaccttctctaccctcttcgaaacctcctaaatttaacctatatccta

SEQ ID NO: 40693 - DNA, 664 bp, Artificial Sequence
  chemically treated genomic DNA (Homo sapiens) CpG-island No: 40693
  misc_feature (420)..(420): n is either a, c, g or t
gttgcgttgttttcgcgtttttattattgtattcggaaggttaaagtagtattaatcgcggcggtggttgtagcgtagatttcgatttttttcgttttttttcgcggttacggtttttttttttcgttagttacgtagttatttattttcgttttcggtttaaattttgcgtgattgtttagcgtttatttttggaggaagaagtaacgttaagtagtcgtagagtacggtatgtttatgcgtatttagtattacgcggttttcgcgtttaaaatattgttttaaaatattcggttcgtcggagtaaacgcgtttgcgttatgtttattaatggttagcgatttagcgtttgcggttcgtttttcggttcgggtttcggggtttttatttatttttttcgttttcgtcgtttttttcgtnttttttattttcgtttttttaagtttgaggacggaagtgacgatagtttcgaaggcgaacggaggcgggttttatttcggcgtttttttttttttggcggaagcgattggttgtcgtgaagcgaaagaggcgggataaattgtcgcgagtttagtgtcgttattggaattaggagatgcggcgtaggagttgtcgttgtgtttgttttaatttgagttttgttttttattgtggtttttgttgt

SEQ ID NO: 40694 - DNA, 664 bp, Artificial Sequence
  chemically treated genomic DNA (Homo sapiens) CpG-island No: 40694
  misc_feature (245)..(245): n is either a, c, g or t
acaacaaaaaccacaataaaaaacaaaactcaaattaaaacaaacacaacgacaactcctacgccgcatctcctaattccaataacgacactaaactcgcgacaatttatcccgcctctttcgcttcacgacaaccaatcgcttccgccaaaaaaaaaaaaacgccgaaataaaacccgcctccgttcgccttcgaaactatcgtcacttccgtcctcaaacttaaaaaaacgaaaataaaaaanacgaaaaaaacgacgaaaacgaaaaaaataaataaaaaccccgaaacccgaaccgaaaaacgaaccgcaaacgctaaatcgctaaccattaataaacataacgcaaacgcgtttactccgacgaaccgaatattttaaaacaatattttaaacgcgaaaaccgcgtaatactaaatacgcataaacataccgtactctacgactacttaacgttacttcttcctccaaaaataaacgctaaacaatcacgcaaaatttaaaccgaaaacgaaaataaataactacgtaactaacgaaaaaaaaaaaccgtaaccgcgaaaaaaaacgaaaaaaatcgaaatctacgctacaaccaccgccgcgattaatactactttaaccttccgaatacaataataaaaacgcgaaaacaacgcaac

SEQ ID NO: 40695 - DNA, 664 bp, Artificial Sequence
  chemically treated genomic DNA (Homo sapiens) CpG-island No: 40695
  misc_feature (245)..(245): n is either a, c, g or t
atagtaggaattataataaggaataagatttaggttaaagtaaatatagcgatagtttttgcgtcgtattttttggttttagtggcggtattgaattcgcggtaatttgtttcgtttttttcgttttacggtagttaatcgttttcgttagagaaagaaaggcgtcgaaatgaaattcgttttcgttcgttttcggaattgtcgttattttcgtttttagatttggaggggcggggatgaggagngcggggaggacgacgagggcgaagagggtgggtgagagtttcggagttcgagtcgaagggcgagtcgtaaacgttaagtcgttggttattggtggatatggcgtaggcgcgtttgtttcgacgggtcgaatgttttggggtagtgttttgagcgcggagatcgcgtgatattggatgcgtatgggtatatcgtgttttgcggttgtttggcgttgtttttttttttagaagtgggcgttgggtagttacgtagggtttgaatcggaagcgggagtaggtagttgcgtggttaacggagaaaagaagtcgtggtcgcgggaggaggcgagaggagtcgggatttgcgttgtagttatcgtcgcggttgatattattttgatttttcgagtgtagtggtaggggcgcggaggtaacgtagt

SEQ ID NO: 40696 - DNA, 664 bp, Artificial Sequence
  chemically treated genomic DNA (Homo sapiens) CpG-island No: 40696
  misc_feature (420)..(420): n is either a, c, g or t
actacgttacctccgcgcccctaccactacactcgaaaaatcaaaataatatcaaccgcgacgataactacaacgcaaatcccgactcctctcgcctcctcccgcgaccacgacttcttttctccgttaaccacgcaactacctactcccgcttccgattcaaaccctacgtaactacccaacgcccacttctaaaaaaaaaaacaacgccaaacaaccgcaaaacacgatatacccatacgcatccaatatcacgcgatctccgcgctcaaaacactaccccaaaacattcgacccgtcgaaacaaacgcgcctacgccatatccaccaataaccaacgacttaacgtttacgactcgcccttcgactcgaactccgaaactctcacccaccctcttcgccctcgtcgtcctccccgcnctcctcatccccgcccctccaaatctaaaaacgaaaataacgacaattccgaaaacgaacgaaaacgaatttcatttcgacgcctttctttctctaacgaaaacgattaactaccgtaaaacgaaaaaaacgaaacaaattaccgcgaattcaataccgccactaaaaccaaaaaatacgacgcaaaaactatcgctatatttactttaacctaaatcttattccttattataattcctactat

SEQ ID NO: 40697 - DNA, 580 bp, Artificial Sequence
  chemically treated genomic DNA (Homo sapiens) CpG-island No: 40697
gcgtaaaagcgtttttattttttcgttttgcgcggttaggtaggcggttggagttgatggtttatttcgcgttttttgttttatttttattcgagatagggaacgaggagtacgttgtagggaaagtagcgagcgtcgggagaggggcggggagaagcgttgataaattagcggtgggggcggagagtcgaggagaaggagaaggaggaggattaggaggaggaggacggcgacgattagaaggggtttaagagagggggcgagcgatcgagcgtcgcgacgcggaagtgaggtgcgtgcgggttgtagcgtagatttcggttcggttttttcgagagcgttttgggcgtttttttacgttttgtttttaagttttttgtttttttattttcgtgagcggagaattgggagtggttattcgacgataggttagcgggtttgttttttatttttttagtttcgcgtcgtcggtttatagcggttttttttggggatagtttttttcgggtgtcgttttcgttttttttgtgcgttttttttttttttttttttttattaaatattatttgggaattgttta

SEQ ID NO: 40698 - DNA, 580 bp, Artificial Sequence
  chemically treated genomic DNA (Homo sapiens) CpG-island No: 40698
taaacaattcccaaataatatttaataaaaaaaaaaaaaaaaaaaaaacgcacaaaaaaaacgaaaacgacacccgaaaaaaactatccccaaaaaaaaccgctataaaccgacgacgcgaaactaaaaaaataaaaaacaaacccgctaacctatcgtcgaataaccactcccaattctccgctcacgaaaataaaaaaacaaaaaacttaaaaacaaaacgtaaaaaaacgcccaaaacgctctcgaaaaaaccgaaccgaaatctacgctacaacccgcacgcacctcacttccgcgtcgcgacgctcgatcgctcgccccctctcttaaaccccttctaatcgtcgccgtcctcctcctcctaatcctcctccttctccttctcctcgactctccgcccccaccgctaatttatcaacgcttctccccgcccctctcccgacgctcgctactttccctacaacgtactcctcgttccctatctcgaataaaaataaaacaaaaaacgcgaaataaaccatcaactccaaccgcctacctaaccgcgcaaaacgaaaaaataaaaacgcttttacgc

SEQ ID NO: 40699 - DNA, 580 bp, Artificial Sequence
  chemically treated genomic DNA (Homo sapiens) CpG-island No: 40699
taaataatttttaaataatatttaataggaaagaagaaggaaaaggagcgtataggaagggcggaggcggtattcgggggggattgtttttagaggaggtcgttgtgagtcggcgacgcgaggttgggggagtgggaggtaaattcgttaatttgtcgtcgaatggttatttttagtttttcgtttacgagggtggaaaggtagaaggtttgaaggtaaggcgtgagggagcgtttaggacgttttcggaggggtcgggtcggggtttgcgttgtagttcgtacgtattttattttcgcgtcgcggcgttcggtcgttcgtttttttttttgggttttttttggtcgtcgtcgtttttttttttttagttttttttttttttttttttttcggtttttcgtttttatcgttgatttgttagcgttttttttcgtttttttttcggcgttcgttgttttttttgtagcgtgtttttcgttttttatttcggatggggatggggtagggggcgcggggtgagttattaattttagtcgtttgtttggtcgcgtaaggcgggaaagtgggggcgtttttgcgt

SEQ ID NO: 40700 - DNA, 580 bp, Artificial Sequence
  chemically treated genomic DNA (Homo sapiens) CpG-island No: 40700
acgcaaaaacgcccccactttcccgccttacgcgaccaaacaaacgactaaaattaataactcaccccgcgccccctaccccatccccatccgaaataaaaaacgaaaaacacgctacaaaaaaaacaacgaacgccgaaaaaaaaacgaaaaaaaacgctaacaaatcaacgataaaaacgaaaaaccgaaaaaaaaaaaaaaaaaaaaaactaaaaaaaaaaaaacgacgacgaccaaaaaaaacccaaaaaaaaaaacgaacgaccgaacgccgcgacgcgaaaataaaatacgtacgaactacaacgcaaaccccgacccgacccctccgaaaacgtcctaaacgctccctcacgccttaccttcaaaccttctacctttccaccctcgtaaacgaaaaactaaaaataaccattcgacgacaaattaacgaatttacctcccactcccccaacctcgcgtcgccgactcacaacgacctcctctaaaaacaatcccccccgaataccgcctccgcccttcctatacgctccttttccttcttctttcctattaaatattatttaaaaattattta

SEQ ID NO: 40701 - DNA, 662 bp, Artificial Sequence
  chemically treated genomic DNA (Homo sapiens) CpG-island No: 40701
aacgggggcgtttttttataggcggttaagatcgcgcgtattattatttttattttttttagtagcgtcgtcgtcgtcgcggtcgtcgcgcgtatcggtatgtttttttggaattgcgataacgcggttatcgtcgtcgtcgttatcgttatgttttggggtagcggcgggggcgggggcggcggcgggcgggggtggcggcggcggcggcggcggcggatgcgggggcggtggttatgcgggcgatagtagatgtttttacggcgtcgcgtttttttttcgattgtttttattgagtaatgttgcgcgtaggaattggcggcggttttagagggggtcgtataggagttagtttgacgagtcgtagggttcgtagaggggggggagacgtgttcggttttataggggtgttcgttgttcgggcgtgcgattgtcgtgtagaggtgggcgcgcggggttggttgttttgggggcgtcgtcgcggtcgggaggtcgagtgggcgagggtacgcgtttttagtgttgattttttcgaggtatttcgggacgtttttttggagggaattttggggggtcgcgtagtgtgtggggtgtttcgtggtagcgggagggtttttcgtttcgtcggtggatcggggggtcgggcgttttaatttttttgt

SEQ ID NO: 40702 - DNA, 662 bp, Artificial Sequence
  chemically treated genomic DNA (Homo sapiens) CpG-island No: 40702
acaaaaaaattaaaacgcccgaccccccgatccaccgacgaaacgaaaaaccctcccgctaccacgaaacaccccacacactacgcgaccccccaaaattccctccaaaaaaacgtcccgaaatacctcgaaaaaatcaacactaaaaacgcgtaccctcgcccactcgacctcccgaccgcgacgacgcccccaaaacaaccaaccccgcgcgcccacctctacacgacaatcgcacgcccgaacaacgaacacccctataaaaccgaacacgtctcccccccctctacgaaccctacgactcgtcaaactaactcctatacgaccccctctaaaaccgccgccaattcctacgcgcaacattactcaataaaaacaatcgaaaaaaaaacgcgacgccgtaaaaacatctactatcgcccgcataaccaccgcccccgcatccgccgccgccgccgccgccgccacccccgcccgccgccgcccccgcccccgccgctaccccaaaacataacgataacgacgacgacgataaccgcgttatcgcaattccaaaaaaacataccgatacgcgcgacgaccgcgacgacgacgacgctactaaaaaaaataaaaataataatacgcgcgatcttaaccgcctataaaaaaacgcccccgtt

SEQ ID NO: 40703 - DNA, 662 bp, Artificial Sequence
  chemically treated genomic DNA (Homo sapiens) CpG-island No: 40703
gtagaggaattagggcgttcgatttttcggtttatcggcgaggcggaaggttttttcgttattacggggtattttatatattacgcgattttttagaattttttttagggaaacgtttcgaaatgtttcgggggaattagtattaggggcgcgtgttttcgtttattcggtttttcgatcgcggcggcgtttttaaggtagttagtttcgcgcgtttatttttatacgatagtcgtacgttcgaataacgagtatttttgtggggtcgaatacgttttttttttttttgcgagttttgcggttcgttaagttagtttttgtgcggttttttttgaagtcgtcgttagtttttgcgcgtagtattgtttagtaggagtagtcggaggaggagcgcggcgtcgtaggagtatttgttgtcgttcgtatgattatcgttttcgtattcgtcgtcgtcgtcgtcgtcgttattttcgttcgtcgtcgttttcgttttcgtcgttgttttagagtatggcggtggcggcggcggcggtggtcgcgttgtcgtagttttagggggatatgtcgatgcgcgcggcggtcgcggcggcggcggcgttgttggggaagatgggggtggtgatgcgcgcgattttggtcgtttgtgggaaggcgttttcgtt

SEQ ID NO: 40704 - DNA, 662 bp, Artificial Sequence
  chemically treated genomic DNA (Homo sapiens) CpG-island No: 40704
aacgaaaacgccttcccacaaacgaccaaaatcgcgcgcatcaccacccccatcttccccaacaacgccgccgccgccgcgaccgccgcgcgcatcgacatatccccctaaaactacgacaacgcgaccaccgccgccgccgccaccgccatactctaaaacaacgacgaaaacgaaaacgacgacgaacgaaaataacgacgacgacgacgacgacgaatacgaaaacgataatcatacgaacgacaacaaatactcctacgacgccgcgctcctcctccgactactcctactaaacaatactacgcgcaaaaactaacgacgacttcaaaaaaaaccgcacaaaaactaacttaacgaaccgcaaaactcgcaaaaaaaaaaaaaacgtattcgaccccacaaaaatactcgttattcgaacgtacgactatcgtataaaaataaacgcgcgaaactaactaccttaaaaacgccgccgcgatcgaaaaaccgaataaacgaaaacacgcgcccctaatactaattcccccgaaacatttcgaaacgtttccctaaaaaaaattctaaaaaatcgcgtaatatataaaataccccgtaataacgaaaaaaccttccgcctcgccgataaaccgaaaaatcgaacgccctaattcctctac

SEQ ID NO: 40705 - DNA, 556 bp, Artificial Sequence
  chemically treated genomic DNA (Homo sapiens) CpG-island No: 40705
agttcgagcgtcggggcgggagggatgatttcggacggtagggggtatcggcgtgcggttcggtcgagtttttaggtagtttcgcgcgtatagtaggatcgttattgacgttatgagcgcgttgttgcggttgttgcgtacgggtgttttagtcgttgcgtgtttgcggttggggattagtgtagggatcgggtcgcgtcgtgttatggttttgtattatattgaggagcgcggttagttttgttcgtagaattatcgttttttttttagtaagtagttttcggaggttcgtcgagcggcgtatcggagaaatttgggtgggggatggaatgggggatatttgggacgtttcgcgcggttttttttttttttttttggggtttttagcggtagtcgcgcggtttaggttattttatttttcgcgggagcgcgtatcgagttacgagaattgttagcgaggaggcggcggattaagattttaaagcggagagtagaggcgtagggttgtcggttggggggtagatagcgttttgtgttttgttagtcgtttttttcg

SEQ ID NO: 40706 - DNA, 556 bp, Artificial Sequence
  chemically treated genomic DNA (Homo sapiens) CpG-island No: 40706
cgaaaaaaacgactaacaaaacacaaaacgctatctaccccccaaccgacaaccctacgcctctactctccgctttaaaatcttaatccgccgcctcctcgctaacaattctcgtaactcgatacgcgctcccgcgaaaaataaaataacctaaaccgcgcgactaccgctaaaaaccccaaaaaaaaaaaaaaaaaaccgcgcgaaacgtcccaaatatcccccattccatcccccacccaaatttctccgatacgccgctcgacgaacctccgaaaactacttactaaaaaaaaaacgataattctacgaacaaaactaaccgcgctcctcaatataatacaaaaccataacacgacgcgacccgatccctacactaatccccaaccgcaaacacgcaacgactaaaacacccgtacgcaacaaccgcaacaacgcgctcataacgtcaataacgatcctactatacgcgcgaaactacctaaaaactcgaccgaaccgcacgccgataccccctaccgtccgaaatcatccctcccgccccgacgctcgaact

SEQ ID NO: 40707 - DNA, 556 bp, Artificial Sequence
  chemically treated genomic DNA (Homo sapiens) CpG-island No: 40707
cggggagggcggttggtagggtatagggcgttatttattttttagtcggtagttttgcgtttttgtttttcgttttggggttttgattcgtcgttttttcgttggtagttttcgtgattcggtgcgcgttttcgcgggaagtaaggtggtttggatcgcgcggttatcgttgagggttttaaaaagagagaagggagatcgcgcggggcgttttaagtgttttttattttattttttatttaggttttttcggtgcgtcgttcggcgaattttcgggagttatttattaaagaagaggcggtaattttgcgagtagggttggtcgcgttttttagtgtggtatagggttatagtacggcgcgattcggtttttgtattggtttttaatcgtaggtacgtagcggttggggtattcgtgcgtagtagtcgtagtagcgcgtttatggcgttaatgacggttttgttgtgcgcgcggagttatttgggggttcggtcgggtcgtacgtcggtgttttttatcgttcggagttatttttttcgtttcggcgttcgggtt

SEQ ID NO: 40708 - DNA, 556 bp, Artificial Sequence
  chemically treated genomic DNA (Homo sapiens) CpG-island No: 40708
aacccgaacgccgaaacgaaaaaaataactccgaacgataaaaaacaccgacgtacgacccgaccgaacccccaaataactccgcgcgcacaacaaaaccgtcattaacgccataaacgcgctactacgactactacgcacgaataccccaaccgctacgtacctacgattaaaaaccaatacaaaaaccgaatcgcgccgtactataaccctataccacactaaaaaacgcgaccaaccctactcgcaaaattaccgcctcttctttaataaataactcccgaaaattcgccgaacgacgcaccgaaaaaacctaaataaaaaataaaataaaaaacacttaaaacgccccgcgcgatctcccttctctctttttaaaaccctcaacgataaccgcgcgatccaaaccaccttacttcccgcgaaaacgcgcaccgaatcacgaaaactaccaacgaaaaaacgacgaatcaaaaccccaaaacgaaaaacaaaaacgcaaaactaccgactaaaaaataaataacgccctataccctaccaaccgccctccccg

SEQ ID NO: 40709 - DNA, 540 bp, Artificial Sequence
  chemically treated genomic DNA (Homo sapiens) CpG-island No: 40709
  misc_feature (535)..(535): n is either a, c, g or t
gatgggcgtgtcgggcgtgtttttttatttcggttcgttgtagttgttgttttgggtttttatcgtttcgcgttaggattacggtttcggtggtttgtaaaattcgcggatcgtttgtgcgcggcgtcgtttttatttttagtatggttagttcgtttttcgttattacgttttagattttcgtatcgttatcgtttttattaatgcgttgtatattttcgtgattagagagatcgattcgttttttattattttcgtttataataatatcggttatgattttttgattcgtcgaacggttatttagttttacgcgttttacgtttgcggattcgtttttacggtaaatttattggtgttcgttaacgtaggtgtgcggttttaattttagcgcgaggtatacgtttttttgcgtgagatattttttcgtcgttagtcgcgaaattatcgttatgttatatacgttattaagtagatattttacgcgaatattcgcgttacgtatgtgcgtatcgtaaaaaagaatgttattaanttagg

SEQ ID NO: 40710 - DNA, 540 bp, Artificial Sequence
  chemically treated genomic DNA (Homo sapiens) CpG-island No: 40710
  misc_feature (6)..(6): n is either a, c, g or t
cctaanttaataacattcttttttacgatacgcacatacgtaacgcgaatattcgcgtaaaatatctacttaataacgtatataacataacgataatttcgcgactaacgacgaaaaaatatctcacgcaaaaaaacgtatacctcgcgctaaaattaaaaccgcacacctacgttaacgaacaccaataaatttaccgtaaaaacgaatccgcaaacgtaaaacgcgtaaaactaaataaccgttcgacgaatcaaaaaatcataaccgatattattataaacgaaaataataaaaaacgaatcgatctctctaatcacgaaaatatacaacgcattaataaaaacgataacgatacgaaaatctaaaacgtaataacgaaaaacgaactaaccatactaaaaataaaaacgacgccgcgcacaaacgatccgcgaattttacaaaccaccgaaaccgtaatcctaacgcgaaacgataaaaacccaaaacaacaactacaacgaaccgaaataaaaaaacacgcccgacacgcccatc

SEQ ID NO: 40711 - DNA, 540 bp, Artificial Sequence
  chemically treated genomic DNA (Homo sapiens) CpG-island No: 40711
  misc_feature (6)..(6): n is either a, c, g or t
tttagnttgatggtatttttttttacgatgcgtatatgcgtggcgcggatattcgcgtggagtgtttgtttaatggcgtgtatgatatggcggtggtttcgcgattagcggcggaaaggtattttacgtaaaaaggcgtatgtttcgcgttggagttggggtcgtatatttacgttggcgagtattagtggatttgtcgtaaaggcgagttcgtaaacgtgaagcgcgtggggttggataatcgttcggcggattagaaaattatgatcgatgttgttgtgggcgggagtgatggggaacgagtcgatttttttgattacgagagtgtataacgtattggtaaaggcgatggcgatgcggagatttggaacgtggtggcggaaaacgaattgattatgttgggagtagaggcgacgtcgcgtatagacgattcgcgagttttataggttatcgaagtcgtggttttgacgcgaggcgatgaggatttaaggtaataattgtagcgagtcggggtagagaaatacgttcggtacgtttatt

SEQ ID NO: 40712 - DNA, 540 bp, Artificial Sequence
  chemically treated genomic DNA (Homo sapiens) CpG-island No: 40712
  misc_feature (535)..(535): n is either a, c, g or t
aataaacgtaccgaacgtatttctctaccccgactcgctacaattattaccttaaatcctcatcgcctcgcgtcaaaaccacgacttcgataacctataaaactcgcgaatcgtctatacgcgacgtcgcctctactcccaacataatcaattcgttttccgccaccacgttccaaatctccgcatcgccatcgcctttaccaatacgttatacactctcgtaatcaaaaaaatcgactcgttccccatcactcccgcccacaacaacatcgatcataattttctaatccgccgaacgattatccaaccccacgcgcttcacgtttacgaactcgcctttacgacaaatccactaatactcgccaacgtaaatatacgaccccaactccaacgcgaaacatacgcctttttacgtaaaatacctttccgccgctaatcgcgaaaccaccgccatatcatacacgccattaaacaaacactccacgcgaatatccgcgccacgcatatacgcatcgtaaaaaaaaataccatcaanctaaa

SEQ ID NO: 40713 - DNA, 24 bp, Artificial Sequence
  Oligonucleotide
gctctatggtcttgtctaaccgta

SEQ ID NO: 40714 - DNA, 18 bp, Artificial Sequence
  Oligonucleotide
aggtggtggtggcggtgg

SEQ ID NO: 40715 - DNA, 28 bp, Artificial Sequence
  Oligonucleotide
atggttttgtttaatygtagagttgttt

SEQ ID NO: 40716 - DNA, 27 bp, Artificial Sequence
  Oligonucleotide
taaacccraaaaaaaaaaacccaatat

SEQ ID NO: 40717 - DNA, 18 bp, Artificial Sequence
  Oligonucleotide
ctactcaacgaaaacaaa

SEQ ID NO: 40718 - DNA, 18 bp, Artificial Sequence
  Oligonucleotide
ctactcaacaaaaacaaa

SEQ ID NO: 40719 - DNA, 20 bp, Artificial Sequence
  Oligonucleotide
agcaacacctccatgcactg

SEQ ID NO: 40720 - DNA, 21 bp, Artificial Sequence
  Oligonucleotide
ttgattggacagcttgaatgc

SEQ ID NO: 40721 - DNA, 13 bp, Artificial Sequence
  Oligonucleotide
gaagagcggacag

SEQ ID NO: 40722 - DNA, 18 bp, Artificial Sequence
  Oligonucleotide
attaatagcgttttggtt

SEQ ID NO: 40723 - DNA, 18 bp, Artificial Sequence
  Oligonucleotide
attaatagtgttttggtt
